United States Patent 7,745,391 (HUMAN THROMBOSPONDIN POLYPEPTIDE) - sequence listing, part 179

SEQ ID NO: 441302 - DNA, 10404 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaagactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441303 - DNA, 10413 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441304 - DNA, 10471 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagtggtttagctcaggatagaagtaaaaaaaaa

SEQ ID NO: 441305 - DNA, 5537 bp, Homo sapiens
tggcacaaatagaagggttttgaggccaggcgaggtggctcacgtctgtagtcccagcactttgggagggtgaggcagggggatcgcttgagctcagaagttcgagaccagccagggcaacatggcaaaactcgatctctacaaaaaaatacaaaaattagcgggatgttgtggtgtgcacctgtactacttatgaggctgaggtgggagaatcacttgagcaccaaagatcgaggctgcagtgagccatgattgtgccactgtactctagcatgggcaacagagtgagaccttgactcaagcaaagcaaaacaaaacaaagaagggttttaaatggcatttcccgtgttgtctcatgcatcatttagaagcaccaccttggaaagagcaaggagattgcaaaccttttctttacaccaacatcaccaagtgatgcactttcatttgagaaacaatgagtgtattttgttatactgtgggtatactcgaatgcccttctaggctgcttcataatcattctggaaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441306 - DNA, 4291 bp, Homo sapiens
atgaatgagtagaatgagtgtgtgtagtagtaggctgtgcactcgggaatgtttggttatagagtttacatgtctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441307 - DNA, 4221 bp, Homo sapiens
  misc_feature (33)..(33): n is a, c, g, or t
gcggacgcgtgggtcgacccacgcgtccggaanatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441308 - DNA, 4257 bp, Homo sapiens
gggcaagctgctgcgtctagagcaacgttgctcccgagacacgaagtacaggagttgctatgtccgagtctcaaccagctatggagctggacactcatgagtgtactactaacattggatccactggttacgcaggcccaatgttcatgttggtaatgactaggtagaaactatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441309 - DNA, 4101 bp, Homo sapiens
  misc_feature (33)..(33): n is a, c, g, or t
gcggacgcgtgggtcgacccacgcgtccggaantagttttcgtttcttaacaattatgtgcttccagttttaagatacccagctattacaaatggagaaatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441310 - DNA, 3996 bp, Homo sapiens
  misc_feature (37)..(37): n is a, c, g, or t
taaacaaaaacctacgctaggtacgaggccgggttgngcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441311 - DNA, 3935 bp, Homo sapiens
acaagctctctaaagccattcgtgaggcgcgcgaccctcatgacgtgtcgttgaacatggtcctattctgatttcctactgcatgatccttggtgcattgacatagtcgtctatggtgattacgtgccacgcagctataagaacacctacaccggctggccattcagcagtcgttgtctggtaagaacacttggaggaatggacgcttgtgacaggtactctctagtgggagtctgtcgacccggaggtgctgatgccgattcatctcattatttatatactaactgctcctgagccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441312 - DNA, 9040 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaaagaaggcaaagttctgtataattttcaagactcttgtaagtagtaacacacagccataagcagccaaaatgctgatggtccctttatttct

SEQ ID NO: 441313 - DNA, 2095 bp, Homo sapiens
cacagaacagtttggcttctctggatatccttataggaaataggggtgagaggtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441314 - DNA, 5542 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaaggtaggtgggtccagagaaatccaaagtggttcatattgagtcgcctttgtatttactgtgtggagtggagacactgtggcagacgcttcattctacccaccatctcctttttgcttctaaacaatgtttagcacattgttgtagccctaggtagatatgagacttacacataaaccatattttctgtctctctccaccagtattttttcacttcctactattaataatataccttccttggtctttgccataaatgttatgcatatcatatgtcaaaactaatcctagatagaataaagagaaaaatgtaggccgggctcagtggctcacgcctctaatcccagcactttgggaggcagaggcgggtggattcacctgaggttgggagtttgaga

SEQ ID NO: 441315 - DNA, 4367 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagtatgtaagcttttctctgggttaagggcatcccagtagtgagactggggcatttttatatgagtgatataagccatacttgctcattaaaactaaaatgagcaagtacaactaatttgtcactggaattctcttcatatatacaggaggattcttttaaaatattttagagaatgtaatttaaatatcagtcattttctttcatttcctctaatctagggttagagttgactttgtattagcacccacaaggttccatttattaggataagtacaaaatttgtttcgtgtgaaataaatggggttgaagttaattcagccaattttctgaataaggt

SEQ ID NO: 441316 - DNA, 873 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggcttttgagaaatgggcttttgagaaatgggcttttgagaaatgggcttttgagaaatgggcttttgagaaatgggcttttgagaaatgggcttttgagaaatgggcttttgagaaatgggctttg

SEQ ID NO: 441317 - DNA, 426 bp, Homo sapiens
agtgctgtgccctctcaaaatatcaaaagatttttccagtattttcaaggttcctcattatactgatattttggttgccttggctttgttgtcttttctagccaagaataaatttgaaataaggggctggctttttgcttccatagtgcttatgggatccagctgggggctgttctgattcacgttcactgcaccctttttcaccgagtctcctcattttctttctctccagtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggtacattagtgggacttgaggtttgcctgggattcagtagactgctc

SEQ ID NO: 441318 - DNA, 447 bp, Homo sapiens
tctggctgtcttacagtgttgccataagtattttctggtatggctcaactaacatatactttcagatacctcattgcctgtgactgtttgctaggcacttggtgaacatacatttactgagcatcttttgtgtaccaggtgctgttttagacatgaggatacagcagtgaactgaatgttttagcatctttttgttgaggaaatatattatctaatcctcctatatctcataagtaataatctggtctgtgcttaaactttagagtcggaaatgtattggtgtctttgagggtcatacctccaaagttaactgcctcctggttactcagacctccgggaagaatgctgccctttacaccgggtccagtgaccataccatccgctgctataatgttaaggtaggtgggtccagagaaatccaaagtggttcatattgagtcgcctttg

SEQ ID NO: 441319 - DNA, 443 bp, Homo sapiens
aaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtgtgtgctgcttttcggtgtcttttttttcctcactttcttttaaagtaaccctttgaccctgatcaagagaattctacgtgtttcatttaattaaatgtttgccaacaatatctgttgta

SEQ ID NO: 441320 - DNA, 10467 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441321 - DNA, 10206 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaataaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441322 - DNA, 9856 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaactcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441323 - DNA, 8024 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441324 - DNA, 10863 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattgacggtttactttcgttaccttgtctgcatattcacggccagccctttccacgttggcttagcgaggaagaaggaaactgggtggaaaacacaggatgcctatagatatgccgcaggccatggtccagagaagtttagcaaacaaacagctgcgttcagggttttgtccacggtcatgcgacaggtcagttagtgagcagaggagctaggatagctcaatctccactccattattcaggtaaccggcccctcccgttgtacatgacccatttattcttgatgtcttttacagcaacaactattcctctgccttccttttatgtcttggaaagtatctgagccattcttatgctcaagaaatagcaataggcatgattacaaaattcaagattttgtt

SEQ ID NO: 441325 - DNA, 5517 bp, Homo sapiens
aggtgtggtggctcacgcctgtaatgggaggctgaggcaggcagatcacctgaggttaggagttcaagaccatcctggccaacatggtgaaaccctgtctttacaaaaatacaaaaattagccaggtgtgatggcgggcgcctgtaatcccagctactcaggaggctgcggcaggagactcacttgaacccaggaagcggaggttggagtgagctgagatggcgccattgcactccagcctgggcgacagagcgagactccgtctcaaaaaaaaaaagtggagaatttgagacttactgaaattacctaggaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441326 - DNA, 8636 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattg

SEQ ID NO: 441327 - DNA, 7128 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaaatcattttgtattacgttcttatttattattaacttcttttgagttttttatactcattcttttttggggggatcttggatacctcaaatgttctctttttatgggggttgtatctacatt

SEQ ID NO: 441328 - DNA, 4642 bp, Homo sapiens
  misc_feature (4579)..(4579): n is a, c, g, or t
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagagtgcgagctttaaagctcgcactcttccctcccagntttttcatctgcactgccaaggactgagtgggttggagtggcaagcattgtgggtgttgggca

SEQ ID NO: 441329 - DNA, 3832 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggacagaatgggagaaaatatttgcaaactgcccatgtgaccagggattaataaccaaagtatataaggagttcagacaactctaagaaatataatctattaaaaaaatgggcaaaagatttgaatagacatttctcatcagaagacatataaatggcaaacaggcatatgaaaaggtgctcaacatcactggtcatcagagaaatgcaaatcaaaacgacaatggaatatcatctcaccgcggttaaaatagcttatatccaaaagacaggcaataacaaatgctggcaaggatgtggacaaaagggaacccttgtacactgttggtgggaatgtaaattagtacagtcactatggagcacagtttggaggtttctcaaatagctaaaaattgagctaccatatgatccagcaattctgctgctgggtatata

SEQ ID NO: 441330 - DNA, 2453 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagttgggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtatgtatcatgttaactttattgttactattaataaacatttcacacatttataaa

SEQ ID NO: 441331 - DNA, 3008 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagttgggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtaaaaaaaaaaaaaaaaaaaaaaaaaaaaaaaaaaaaaaaaaaaaaaaaaaaaaaaaaaaaaaaaaaaaaaaatgtggcccgcttggcccaagcgaattttaaattgaacaaggttaatccatgcgcccgaatttgaagttaattggccaaattcccctaatagggagccgaataaaaattaatggcccgtcgtttaaaaacgtcggaattggaaaaaccttggggtacccaaattaaatccctttgaagaaaatccccttttggcaagttgcggaaaaaccaaaaagccccgaacggatggcctttccaaaaagttgccaaccttgaagggcaatggaaaattgaaggcgtaaatatttggtaaaaatcccgttaaaattttggtaaaacaagttaatttttaaaccaatgggccgaattgggaaaaacccttaataattaaaaggattaacccgaaatagggtggagggtggtccaatttggaacaaggagcccttattaaaaacggggacttaaaggtaaagggcaaaaaaacggtttataaggcgagggccctttcgggaaccatcaccttaacaaagtttttgggcccaaggtcccaaaaacacta

SEQ ID NO: 441332 - DNA, 2292 bp, Homo sapiens
cagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaagatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagttgggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtatgtatcatgttaactttattgttactattaataaacatttcacacatttataaa

SEQ ID NO: 441333 - DNA, 2324 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaagtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagttgggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtatgtatcatgttaactttattgttactattaataaacatttcacacatttataaa

SEQ ID NO: 441334 - DNA, 2400 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaagtccatgaccacacgtctgtaccatgcaatttaactcttatttacattgttatgtttagttgggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtatgtatcatgttaactttattgttactattaataaacatttcacacatttataaa

SEQ ID NO: 441335 - DNA, 1552 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctaagagagaagagacttcagaggttgtcgacc

SEQ ID NO: 441336 - DNA, 2350 bp, Homo sapiens
cagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagttgggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtatgtatcatgttaactttattgttactattaataaacatttcacacatttataaa

SEQ ID NO: 441337 - DNA, 2955 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagttgggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtaaaaaaaaaaaaaaaaaaaaaaaaaaaaaaaaaaaaaaaaaaaaaaaaaaaaaaaaaaaaaaaaaaaaaaaatgtggcccgcttggcccaagcgaattttaaattgaacaaggttaatccatgcgcccgaatttgaagttaattggccaaattcccctaatagggagccgaataaaaattaatggcccgtcgtttaaaaacgtcggaattggaaaaaccttggggtacccaaattaaatccctttgaagaaaatccccttttggcaagttgcggaaaaaccaaaaagccccgaacggatggcctttccaaaaagttgccaaccttgaagggcaatggaaaattgaaggcgtaaatatttggtaaaaatcccgttaaaattttggtaaaacaagttaatttttaaaccaatgggccgaattgggaaaaacccttaataattaaaaggattaacccgaaatagggtggagggtggtccaatttggaacaaggagcccttattaaaaacggggacttaaaggtaaagggcaaaaaaacggtttataaggcgagggccctttcgggaaccatcaccttaacaaagtttttgggcccaaggtcccaaaaacacta

SEQ ID NO: 441338 - DNA, 3011 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
  misc_feature (1814)..(1814): n is a, c, g, or t
  misc_feature (1826)..(1826): n is a, c, g, or t
  misc_feature (1858)..(1858): n is a, c, g, or t
  misc_feature (1875)..(1875): n is a, c, g, or t
  misc_feature (1885)..(1885): n is a, c, g, or t
  misc_feature (1896)..(1896): n is a, c, g, or t
  misc_feature (1902)..(1902): n is a, c, g, or t
  misc_feature (1911)..(1911): n is a, c, g, or t
  misc_feature (1926)..(1926): n is a, c, g, or t
  misc_feature (1936)..(1936): n is a, c, g, or t
  misc_feature (1938)..(1938): n is a, c, g, or t
  misc_feature (1947)..(1947): n is a, c, g, or t
  misc_feature (1956)..(1956): n is a, c, g, or t
  misc_feature (1958)..(1959): n is a, c, g, or t
  misc_feature (1965)..(1965): n is a, c, g, or t
  misc_feature (1981)..(1981): n is a, c, g, or t
  misc_feature (1984)..(1986): n is a, c, g, or t
  misc_feature (2000)..(2000): n is a, c, g, or t
  misc_feature (2003)..(2005): n is a, c, g, or t
  misc_feature (2009)..(2009): n is a, c, g, or t
  misc_feature (2013)..(2015): n is a, c, g, or t
  misc_feature (2017)..(2019): n is a, c, g, or t
  misc_feature (2022)..(2022): n is a, c, g, or t
  misc_feature (2028)..(2028): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcccccccccccccaccccccncccccccccccncctccgcccccccccccccccccccccccccncccccctccccctcccncccccccccnccctccccccncgttcnttctcctcntcttccccccccccncccccccccncnccccccggnccccccccncnnctattnctcccccccacccccnccnnncccccccccccccncgnnnctanagcnnncnnnccncatgcncccaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtaaaaaaaaaaaaaaaaaaaaaaaaaaaaaaaaaaaaaaaaaaaaaaaaaaaaaaaaaaaaaaaaaaaaaaaatgtggcccgcttggcccaagcgaattttaaattgaacaaggttaatccatgcgcccgaatttgaagttaattggccaaattcccctaatagggagccgaataaaaattaatggcccgtcgtttaaaaacgtcggaattggaaaaaccttggggtacccaaattaaatccctttgaagaaaatccccttttggcaagttgcggaaaaaccaaaaagccccgaacggatggcctttccaaaaagttgccaaccttgaagggcaatggaaaattgaaggcgtaaatatttggtaaaaatcccgttaaaattttggtaaaacaagttaatttttaaaccaatgggccgaattgggaaaaacccttaataattaaaaggattaacccgaaatagggtggagggtggtccaatttggaacaaggagcccttattaaaaacggggacttaaaggtaaagggcaaaaaaacggtttataaggcgagggccctttcgggaaccatcaccttaacaaagtttttgggcccaaggtcccaaaaacacta

SEQ ID NO: 441339 - DNA, 2357 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagttgggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaagaggaaaaatatatcaaaataaaaaaatgcaaaatgagaattaataaatgcttaaacatcagtatgtatcatgttaactttattgttactattaataaacatttcacacatttataaa

SEQ ID NO: 441340 - DNA, 801 bp, Homo sapiens
  misc_feature (6)..(6): n is a, c, g, or t
  misc_feature (78)..(78): n is a, c, g, or t
  misc_feature (83)..(83): n is a, c, g, or t
  misc_feature (96)..(96): n is a, c, g, or t
  misc_feature (101)..(101): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (137)..(138): n is a, c, g, or t
  misc_feature (140)..(140): n is a, c, g, or t
gagganggggaggatgagtggggaaatgagtttgaaggcagtacagggagaggcagaaagaggggagtggggtgtaanggggngaaggacgggggngaggntngagaggaggaggngngtgaaagngagcgcggtgnngncgggagagacagagggggagaagagggggagctggcaggaacaggagggtatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgctgggtctctaggaggactctatgaactaatatatgttttggataaagcttccatgaagcggaaaggtatgcctagaaatagagctctgact

SEQ ID NO: 441341 - DNA, 6033 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatcctt

SEQ ID NO: 441342 - DNA, 843 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaagtaagtcatcatttaacaaatga

SEQ ID NO: 441343 - DNA, 312 bp, Homo sapiens
ccagtttcgcataagttgagagtaggtattcttgaacctgtgatcctgatttgaaaaatagctctctcatatggtaaaaaaaacaaaacaaaacaaaacaaaaccacgaacagtcttgctagtcccttttctcatatgggaatttttactgtggggattctaactattgggatactttttaaggcatattcctctataaaacataaaatgtctagacttacctggttttgaacagcttagtgttaaaagagtaactttgattacgtaaaaagcctttgaagtattttaatgaacactagtctttgctattgg

SEQ ID NO: 441344 - DNA, 6128 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggctggagtgcagtggtgcaatctcagcttactgcaatctccgtctcctgagttcaagcagttctgcctcagcctcctgagtagctgtgactacaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatcctt

SEQ ID NO: 441345 - DNA, 4990 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatcctt

SEQ ID NO: 441346 - DNA, 5975 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgat

SEQ ID NO: 441347 - DNA, 6326 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgataaaaagctaaaaaagaaaaacattgtgtggcgggcgcgcgccaccaaggagagtttaaacacaactggggtggggcggcgcccaaggatatgacacaggggacacgtgccccctgacacgctgccagccaagggtgggtctcccaaaaaaagccggggcacgacggtagaacaccagagagtggggactggcaagccgcgaaacagcgtgcactcgctgcctctctaccgacactgactcgacacgccatacaagagcagaggcagcatccgaagacgagcacgactagtgaaagacgcgctagagacacactggatacttgatagtcgtcgacgcgaggggagggggggg

SEQ ID NO: 441348 - DNA, 5492 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctggtatgtttcattcccccgtaaaattacataatattaaaatttattgcatttaaatcagatgaacttattgctgttagtgagatggtgaagcactttaaccttttgaatcaataggttcaaatttaacccaagaaaagagttgctcttactatctactgctgactcttgaactttttaaataatgtattgagtttacttaataaaatgatactcttgct

SEQ ID NO: 441349 - DNA, 5427 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaagctggagtgcaatggcgtgatctcagctcaccgtaatctccgcctccctggttcaagtgattctcctgcctcagcctactgagtagctgggattacaggcatgtgcgct

SEQ ID NO: 441350 - DNA, 5341 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagaggggaacgctatccaaaagttgggagataaacgttaaatcatctgatcgaaatttt

SEQ ID NO: 441351 - DNA, 6571 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaagtaagtcactgggctttcttcccgaatagctcgttagaaccacttacatacaaagcaatcttcttacctaccgcgtgaagcgtgatttctaaagggggcagacaggattcattttaagtaacctttcatgactcttacataccagtgagagagaagagattctcatttagaaagactgaattatggcttagggtcagaattctagaagtatggggtctcaaatataacttcaaacttttaaaaagcaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgataaaaagctaaaaaagaaaaacattgtgtggcgggcgcgcgccaccaaggagagtttaaacacaactggggtggggcggcgcccaaggatatgacacaggggacacgtgccccctgacacgctgccagccaagggtgggtctcccaaaaaaagccggggcacgacggtagaacaccagagagtggggactggcaagccgcgaaacagcgtgcactcgctgcctctctaccgacactgactcgacacgccatacaagagcagaggcagcatccgaagacgagcacgactagtgaaagacgcgctagagacacactggatacttgatagtcgtcgacgcgaggggagggggggg

SEQ ID NO: 441352 - DNA, 6413 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagttctcctttcagattgatgctcagaccttgcttatccatatccagcaatactttatattgtatttaccgtttcacaatttacttttgggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgataaaaagctaaaaaagaaaaacattgtgtggcgggcgcgcgccaccaaggagagtttaaacacaactggggtggggcggcgcccaaggatatgacacaggggacacgtgccccctgacacgctgccagccaagggtgggtctcccaaaaaaagccggggcacgacggtagaacaccagagagtggggactggcaagccgcgaaacagcgtgcactcgctgcctctctaccgacactgactcgacacgccatacaagagcagaggcagcatccgaagacgagcacgactagtgaaagacgcgctagagacacactggatacttgatagtcgtcgacgcgaggggagggggggg

SEQ ID NO: 441353 - DNA, 5448 bp, Homo sapiens
  misc_feature (5321)..(5321): n is a, c, g, or t
  misc_feature (5331)..(5331): n is a, c, g, or t
  misc_feature (5335)..(5336): n is a, c, g, or t
  misc_feature (5338)..(5338): n is a, c, g, or t
  misc_feature (5349)..(5349): n is a, c, g, or t
  misc_feature (5353)..(5353): n is a, c, g, or t
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggggagtggcgcgcggcacgagtacctggggagggatgtgtacgttccctcgtgctggcgaagcggtggtgcgtggcgtggctgagtttctgtcgtccatttctagagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaantgaagtcgtntcanngnagttggacaantganctggcgaccgcggcccgatcagaggaggccctatccaaaagtggcgacacaaacgaaatcacggacagaaattacgcccggggcacggcaggccc

SEQ ID NO: 441354 - DNA, 5085 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagatggagtcttgatgccacgcccaggctgcagtagagtgcagtgatctcagctcactgcaacctccgcttcccaggttcaagcgattctcctgcctcggccctg

SEQ ID NO: 441355 - DNA, 5225 bp, Homo sapiens
  misc_feature (4206)..(4206): n is a, c, g, or t
  misc_feature (4920)..(4920): n is a, c, g, or t
  misc_feature (4967)..(4967): n is a, c, g, or t
  misc_feature (4985)..(4985): n is a, c, g, or t
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaaggtgagaaggaaaatgtgtatgttgacttattttagggtttcccctcttaaagtttcaatgatttcacagtatctcttgttataacctgaggcgattaagtgtcatatttgtgtgaacatggtaaaaatggaaattttaaaggtaatttgaaaatgaatagtggaatgcatttaaaagcttgagaaggctttaatgtgctttgcttgagccatccatggcattttattgtggaccagaacacatgctagaaattgcacccaggcccaaatccaaacctgtttgagaattcattatatgcagtggttgactatatggcatgagcagcttaaatctatttctgtaacattgtttttgcaattgtaatgtgcagtttctcacgaacattttgatttattgacagaccccnccacccttaaccaaatactgtatgtaggggtttggagcaaccaactgtccaggcactgctttcctcagacaaccgtgtcaaactgattttcaagcctgactaacttgtgtgagtttgtaaaggaatttgatgctttcttagatgcatagcttccaaattgaaggaccaatgtgtacgttaataacctacagtaatacttttttgattttccgtgaaattgttaaaagtggaaattcaaatcggtaccttcccaaagtattagtgcctttcgatggtgccatagccatacttctgtcatcatttttcttataaaccacttcattcaggtatctttaaatcagtatactctaggctgacacctggctttggaacacacttttccatcgtaaagacagagcactggagtatgttttttatataccgtaaaagattttagaatgctagctttaggttttcagcaaagcttaaagagatatggtctagatcaaattagttaattctatgttttctcaggaatcttgacttaaaacatttctgttttaaaataaattaaaaaaatacttgcaattaaattgaaatgttctttgctttttttcacatttacaagtataactactatgattttatctgtgccatactatctcatgcaactgaactatccaggcatgactaatcttcaaaatgaaagaatcctttatttcagaatattaggcnttcaacagtaagattttactggccaggtgtggtcactcacacctgtnatcccagcaatttgggangtctgggaggtcaaggcggtggatcgcttgagtccaggagttcaagaccagcctggacaacatggcaaaaccccatctctaccaaaaatacaaacgtcagccagctgtggtggcgcatgcctgtagtcccagctaccttgggggctgatgagggagaatcacttgatcccggaaaggctgcagtgagccaagatcacgccactgcactccagcctgggtgataaaacaagaccctgtctc

SEQ ID NO: 441356 - DNA, 2357 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaaggcataattaaactttacttcctctctttcttcttcccactcatcctaaccctactcctaatcacataacctattcccccgagcaatctcaattacaatatataccccaacaaacaatgttcaaccagtaactactactaatcaacgcccataatcatacaaagccccc

SEQ ID NO: 441357 - DNA, 1795 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggaagtgctaggtaagaagtgtagggggggtatacctctagagacgactatgcacccagacacgatgcactgccgt

SEQ ID NO: 441358 - DNA, 956 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaaggagaggagggagggagggagagggagagaggtg

SEQ ID NO: 441359 - DNA, 532 bp, Homo sapiens
gttaatacacagtactttattgtacagactgtgtattaacagtgccagatattaaatagcttgaatgaacacatccacaatatacaaatgtcttacaaaggtgaagaatgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatcctt

SEQ ID NO: 441360 - DNA, 595 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggtaagattgcctgcggaaaacgaatctctggggttatcgaattcaggaagtaggaggtttcgacgaggtcgtcgtgtggggcttccgagttttgcagaggaaggtgtgtttggtgacttggtg

SEQ ID NO: 441361 - DNA, 786 bp, Homo sapiens
gacagagcgagactttgtctcaaaaaacaaacaaacaaaaaaaaacgaaaaaaggaaacagtgagagacttcctctgatgaaaataactaatgtgttatttgctttgtaaacctagtggcggagaatgcaacagttgagctatgcactgttttgatccaacttgaagaagcaattaagcctcccactcttgtcaccatttacatgtacaagaaaactcctaagtacagaaagatggagggattaggaggggacaaatgatttttggatggattgcagatttttcctgttttgatacttgtttcactgttacaaaaagtgtattctgtattttatttctgtgtcttgtagactaggcacagttctttccctctttgacccacgcaggagccttccctggtctgtccttttcattacttctgtagttgggcactgtctagcttcttgagctacactagcttttcctttcttcacatcgtagaactgtgagaattgaccactgttgttgtaagctaaatgattttggacaatatagcggaattttagttcagaggactagtattttctgtctattgttagacataaatttttattaagctcttggtttggtctcccttttccttaggtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatgg

SEQ ID NO: 441362 - DNA, 380 bp, Homo sapiens
aaagagtaactttgattacgtaaaaagcctttgaagtattttaatgaacactagtctttgctattggtaagaaatctgcttgttttattaaaatgcttaattgaagaaaataatattcttctgtgattaaaattaggaagaaatagaaccatttccagaagaaagggagaactttcttcagcaattgtacaaatttatggaagatagaggtgagtattttttatttatcattaacgtggtaagttttggacagataattagtatcttaaaaataagaatagaattttgtttactgaactttatgtcatcagtaattatggctgtctttttgactctgatatcaccagcacctagcatagcgcctgtcacgtaacaagtag

SEQ ID NO: 441363 - DNA, 5775 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatcctt

SEQ ID NO: 441364 - DNA, 4384 bp, Homo sapiens
  misc_feature (3365)..(3365): n is a, c, g, or t
  misc_feature (4079)..(4079): n is a, c, g, or t
  misc_feature (4126)..(4126): n is a, c, g, or t
  misc_feature (4144)..(4144): n is a, c, g, or t
ctgggaataggggaaatcagtgaatgaagcctcctatgatggcaaatacagctcctattgataggacatagtggaagtgagctacaacgtagtacgtgtcgtgtagtacgatgtctagtgatgagtttgctaatacaatgccagtcaggccacctacggtgaaaagaaagatgaatcctagggctcagagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaaggtgagaaggaaaatgtgtatgttgacttattttagggtttcccctcttaaagtttcaatgatttcacagtatctcttgttataacctgaggcgattaagtgtcatatttgtgtgaacatggtaaaaatggaaattttaaaggtaatttgaaaatgaatagtggaatgcatttaaaagcttgagaaggctttaatgtgctttgcttgagccatccatggcattttattgtggaccagaacacatgctagaaattgcacccaggcccaaatccaaacctgtttgagaattcattatatgcagtggttgactatatggcatgagcagcttaaatctatttctgtaacattgtttttgcaattgtaatgtgcagtttctcacgaacattttgatttattgacagaccccnccacccttaaccaaatactgtatgtaggggtttggagcaaccaactgtccaggcactgctttcctcagacaaccgtgtcaaactgattttcaagcctgactaacttgtgtgagtttgtaaaggaatttgatgctttcttagatgcatagcttccaaattgaaggaccaatgtgtacgttaataacctacagtaatacttttttgattttccgtgaaattgttaaaagtggaaattcaaatcggtaccttcccaaagtattagtgcctttcgatggtgccatagccatacttctgtcatcatttttcttataaaccacttcattcaggtatctttaaatcagtatactctaggctgacacctggctttggaacacacttttccatcgtaaagacagagcactggagtatgttttttatataccgtaaaagattttagaatgctagctttaggttttcagcaaagcttaaagagatatggtctagatcaaattagttaattctatgttttctcaggaatcttgacttaaaacatttctgttttaaaataaattaaaaaaatacttgcaattaaattgaaatgttctttgctttttttcacatttacaagtataactactatgattttatctgtgccatactatctcatgcaactgaactatccaggcatgactaatcttcaaaatgaaagaatcctttatttcagaatattaggcnttcaacagtaagattttactggccaggtgtggtcactcacacctgtnatcccagcaatttgggangtctgggaggtcaaggcggtggatcgcttgagtccaggagttcaagaccagcctggacaacatggcaaaaccccatctctaccaaaaatacaaacgtcagccagctgtggtggcgcatgcctgtagtcccagctaccttgggggctgatgagggagaatcacttgatcccggaaaggctgcagtgagccaagatcacgccactgcactccagcctgggtgataaaacaagaccctgtctc

SEQ ID NO: 441365 - DNA, 869 bp, Homo sapiens
tgggaaaatgatgtgctttcctctcatgataaactcttgctgttattttttagaaatttagaaaatgatttaagatttaaattagccattttacaggtcttaggaaatgtaataagagtttgggaatacctatattcatcattggcatgcttattctttgtgaggataaatggaaatattttatttttttctctccctagaccagaggaagagtcttcatcatcctccagtgatgaagatgaggatgataggaaacagattgatgagctactaggcaaagttgtatgtgtagattacattagtttggataaaaagaaagcactgtggtttcctgcattggtgagtagcttcagtatacaagagtttaatttcaaactttataagtttatgaagaaaacaattttcttactaatgtttttcataggtacaaaatgaggaaatgtttttagcattatttagttcacactaagcttactttcaacgttgtctttgaatacaaagaactcttgatgtcattcaggaaaggcaaaatcttgataatcttagaggtttagctatgtggaagttgaattctctctctctcggtagaaaattcatgatgcaaacttttaaagctcctaagtccatgtaggtctagattgcaaaagaacaacagaatctttcttggttgacagggataactagaccttttcctcatacttagtgaatcagggtgtttccatccttgatcttaatcttgccttttaggtactccctatataatcatgactgcaattatacattaccccactcttcaattttctctacagtagattgttaattctacctactttttaatgtttttctctccaaaagattgcaattcctta

SEQ ID NO: 441366 - DNA, 4801 bp, Homo sapiens
gaacgcaccgggaggtttccgaagaggagattccgggctcatccaaataacacaaatatgaatatataatataagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatcctt

SEQ ID NO: 441367 - DNA, 6088 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgtcagttgagtgcaggtgacagcaggacttgctaaagcactttgcacttaatggctgttgagggccactttttttttatactgcacagtggcacaaaaaaatatcagacaagcactattttatatttaaaaattgtttcttgacaagctgacttggcacttaagtgcacttttttatgaagaaaaagtacaatgaactgcttttcctcaagcaataattgtttccaacttgtctgggaattgtgtgtctggtaactggaaggccttccactgtggcaaatggaggcttttcactgcctgtagagacaatacagtaagcatagttaaggggtgggtcagaacatgttaagataacttactgtatatgtattcccttgtattttgttaaagctggaacatttgatatttttccatttatttatgaaaaaatatgaacctattttcatttgtacaaggtaattgttttttaaagcaagtcaccttagggtggctttaattgtataagtcaagcacatgtaataaattcaaaacctgcagttaacaggatattagacatcaatcctggtaaccaaatattaaagattctctttaaaaaagactgaacatgtttacaggtttgaattaggctaaaaggtcttgcagtggcttttcatggcccttcaaattggaatggaactactgtactttgccatttttctataaatcagtatttttttttaattttgatatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagctacaacaaaaggacttcaggaacaagtaatgtattagtatggttcaagattgttgataggaactgtctcaaaaggatggtggttattttaaatataaatagctaatgggggtggtaggcctataaaattaaatgccttgtataaaatccaaaatgaatgcaaaattgttttcacttgtattgactttatgttgtatgattccaatctctgttctgtttggcacttgtatttaattcttcacctttgtaagacatttgtatattgtggatgtgttcattcaagctatttaatatctggcactgttaatacacagtactttattgtacagactgttttactgttttaattgtagttctgtgtactttttttggatggggctggcatgttttctttgtttcctggcaatacgacgtgggaatttcaatgcgttttgttgtagatgctaacgtgtcagaatcctttacattcaacttttctaagaaaagcattttcagtcttgtagtgtgtgcttacagtaactaattttgttgaaaatggtttcaagttattcaaatttgtacaggactgtaaagatttgttgacagcaaaatgttgaagaaaaaagcttatagaataaaagctataaagtatatattaggatctgcaaacaatgaagaattatgtaatatattgtacaaatgtaagcaaaggctctgaaataaaatgccatagtttgtgaatccttgaatttttgtttctaaaagatttagtaattttagttcatttctgtatgtgatgac

SEQ ID NO: 441368 - DNA, 3835 bp, Homo sapiens
atagaggatcccattctacgctgcacgtgtctgccatcgctcaaatcctcaaggcagaatgtttagcaatgctgggtcgttatccagaagcacagtctgtggctagtgacattctacgaatggatccaccaatgcagatgctctgtatgtacgaggtctttgcctttatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgat

SEQ ID NO: 441369 - DNA, 6189 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaaggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgataaaaagctaaaaaagaaaaacattgtgtggcgggcgcgcgccaccaaggagagtttaaacacaactggggtggggcggcgcccaaggatatgacacaggggacacgtgccccctgacacgctgccagccaagggtgggtctcccaaaaaaagccggggcacgacggtagaacaccagagagtggggactggcaagccgcgaaacagcgtgcactcgctgcctctctaccgacactgactcgacacgccatacaagagcagaggcagcatccgaagacgagcacgactagtgaaagacgcgctagagacacactggatacttgatagtcgtcgacgcgaggggagggggggg

SEQ ID NO: 441370 - DNA, 5306 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagtgtggagagaggggtaccgagctcg

SEQ ID NO: 441371 - DNA, 6266 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgataaaaagctaaaaaagaaaaacattgtgtggcgggcgcgcgccaccaaggagagtttaaacacaactggggtggggcggcgcccaaggatatgacacaggggacacgtgccccctgacacgctgccagccaagggtgggtctcccaaaaaaagccggggcacgacggtagaacaccagagagtggggactggcaagccgcgaaacagcgtgcactcgctgcctctctaccgacactgactcgacacgccatacaagagcagaggcagcatccgaagacgagcacgactagtgaaagacgcgctagagacacactggatacttgatagtcgtcgacgcgaggggagggggggg

SEQ ID NO: 441372 - DNA, 5347 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaaccagaacatcctgaaaaagcctgtacaggtcagaaaagagtgaaagatgctcagggaggaggaagttcatcaaaaaagcagaaaagaagccataaagcaacagtggtaaacaacaaaaagaagggaaaaggcacaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacaggttggtaaaattctcttatttgatgttaaagaaattagatggtaaattaacattcctatacttggaatattcgtcagttttatttcatatttctactttctttcaaaacttttattatggaaaatccagtacatatagaaaagttgaaaaggctaagaaaccccgtgtactcagcatcagcaattactaatatttggctaacctttttgtatttttaccccactcatataccccctcattatttgtttttgtttgttttgagatggagtcttgatgccacgcccaggctgcagtagagtgcagtgatctcagctcactgcaacctccgcttcccaggttcaagcgattctcctgcctcggccctg

SEQ ID NO: 441373 - DNA, 2780 bp, Homo sapiens
tgttacatattcattgtagaggtttctacaattaatcattttaaaagatgatatattttatgtattaacataatagagtaaaaagccattcagatgattactgtatatttgacagtctaccaagcataatgatagattagtgtgagtgattttaaaagtatacatattattggcagttcaggtaagaagaattttttgtttttgcttttcctaagatgctgctgcatttgtatatgattttccaggtttctaggcaggttgttttctgtaggactaaattcaaatggctaattttaaattacctactaaaatctgtgacaaatttattgttacatttttgtttattaaatcttttctttctctttcagcaaatagtagtgatagtgaagaactttcagctggtgaaagtataactaagagtcagccagtcaaatcagtttccactggaatgaagtctcatagtaccaaatctcccgcaaggacgcagtctccaggaaaatgtggaaagaatggtgataaggatcctgatctcaaggaacccagtaatcgattacccaaagtttacaaatggagttttcagatgtcggacctggaaaatatgacaagtgccgaacgcatcacaattcttcaagaaaaacttcaagaaatcagaaaacattatctgtcattaaaatctgaagtagcttccattgatcggaggagaaagcgtttaaagaagaaagagagagaaagtgctgctacatcctcatcctcctcttcaccttcatccagttccataacagctgctgttatgttaactttagctgaaccgtcaatgtccagcgcatcacaaaatggaatgcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgataaaaagctaaaaaagaaaaacattgtgtggcgggcgcgcgccaccaaggagagtttaaacacaactggggtggggcggcgcccaaggatatgacacaggggacacgtgccccctgacacgctgccagccaagggtgggtctcccaaaaaaagccggggcacgacggtagaacaccagagagtggggactggcaagccgcgaaacagcgtgcactcgctgcctctctaccgacactgactcgacacgccatacaagagcagaggcagcatccgaagacgagcacgactagtgaaagacgcgctagagacacactggatacttgatagtcgtcgacgcgaggggagggggggg

SEQ ID NO: 441374 - DNA, 2886 bp, Homo sapiens
  misc_feature (2885)..(2885): n is a, c, g, or t
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatattgaaagtggagctgtttggaaacaagtctaccaagatcttggaatccctgtcttaaattcagctgcaggatacaatgttaaatgtgcttataaaaaatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctgggaagtaaaaagaatttattagaatctatacctacacattctgatcaggaaaaagaagttaacattaaaaaaccagaagacaatgaaaatctggatgacaaagatgatgacacaactagggtagatgaatccctcaacataaaggtagaagctgaggaagaaaaagcaaaatctggagatgaaacgaataaagaagaagatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgagatacgatgaatggattaaagcagataaaatagtaagacctgctgataaaaatgtgccaaagataaaacatcggaagaaaataaagaataaattagacaaagaaaaagacaaagatgaaaaatactctccaaaaaactgtaaacttcggcgcttgtccaaaccaccatttcagacaaatccatctcctgaaatggtatccaaactggatctcactgatgccaaaaactctgatactgctcatattaagtccatagaaattacttcgatccttaatggacttcaagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatttatctgttgtgtccttcttgacatcctttctcttttttgtgacttcatcttcttcataatcang

SEQ ID NO: 441375 - DNA, 1734 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtggtttgtcctgattgtagtgatgagattgctgtaaaaaaggacaatattcttgttcgatctttcaaagatggaaaatttacttcagttccaagaaaagatgtccatgaaattactagtgacactgcaccaaagcctgatgctgttttaaagcaagcctttgaacaggcacttgaatttcacaaaagtagaactattcctgctaactggaagactgaattgaaagaagatagctctagcagtgaagcagaggaagaagaggaggaggaagatgatgaaaaagaaaaggaggataatagcagtgaagaagaagaagaaatagaaccatttccagaagaaagggagaactttcttcagcaattgtacaaatttatggaagatagaggtacacctattaacaaacgacctgtacttggatatcgaaatttgaatctctttaagttattcagacttgtacacaaacttggaggatttgataatgtgagtgttgtagtcaaactgaaacatctttttcatgtaacatgttttctcaggtatctgccatctctgaaattgtttttctaaacaacaaaacaaagtttttcagtaaaaacctaagaagaagataaagtggaaagtacactacttgggaggctgaggcaggagaatcgcttgaacctgggaggcggaggttgcagtgagcc

SEQ ID NO: 441376 - DNA, 1581 bp, Homo sapiens
agcgatgtttgcccgtcagtcgagtccggagtgaggagctcggtcgccgaagcggagggagactcttgagcttcatcttgccgccgccacggccaccgcctggacctttgcccggagggagctgcagagggtccatcgccgccgtcctctggagggcagcgcgattgggggcccggacctccagtccgggggggatttttcgtcgtccccctccccccaaccagggagcccgagcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacagaggagccttttgtgaagccaagatcaagacagcaaaaagacttgtcaaagtcaaggtgacatttagacatgattcttcaacagtggaagttcaggatgaccacataaagggcccactaaaggtaggagctattgtggaagtgaagaatcttgatggtgcatatcaggaagctgttatcaataaactaacagatgcgagttggtacactgtagtttttgatgacggagatgagaagacactgagacgatcttcactgtgcctgaaaggagagaggcattttgctgaaagtgaaacattagaccagctcccactcaccaaccctgagcattttggcactccagtcataggaaagaaaacaaatagaggaagaagatctaatcatataccagaggaagagtcttcatcatcctccagtgatgaagatgaggatgataggaaacagattgatgagctactaggcaaagttgtatgtgtagattacattagtttggataaaaagaaagcactgtggtttcctgcattggtgagtagcttcagtatacaagagtttaatttcaaactttataagtttatgaagaaaacaattttcttactaatgtttttcataggtacaaaatgaggaaatgtttttagcattatttagttcacactaagcttactttcaacgttgtctttgaatacaaagaactcttgatgtcattcaggaaaggcaaaatcttgataatcttagaggtttagctatgtggaagttgaattctctctctctcggtagaaaattcatgatgcaaacttttaaagctcctaagtccatgtaggtctagattgcaaaagaacaacagaatctttcttggttgacagggataactagaccttttcctcatacttagtgaatcagggtgtttccatccttgatcttaatcttgccttttaggtactccctatataatcatgactgcaattatacattaccccactcttcaattttctctacagtagattgttaattctacctactttttaatgtttttctctccaaaagattgcaattcctta

SEQ ID NO: 441377 - DNA, 3329 bp, Homo sapiens
cgtgaagcatctacaaaggaggaatagtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctctatgtgctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattatgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatatatacatctttgtat

SEQ ID NO: 441378 - DNA, 949 bp, Homo sapiens
cgtgaagcatctacaaaggaggaatagtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtgaaagagtgatggatcttgaagaatttgaagctaactccaggacaggcagaggacaaacaaggatgctgatgaagtcttcttgcattccccatttctcgtctcatgctcccttctcatgcctcccttcatcttcagatgaac

SEQ ID NO: 441379 - DNA, 1034 bp, Homo sapiens
cgtgaagcatctacaaaggaggaatagtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggatacactgagaagcacaagcttcttctgtgacattcttgccaacattatcagcacctgagtgtaagtacagaaacatcagacggcattgaattgagggatattctaccaaataattggctgaaactctctaaaagaggcaatgtcataaaagacaagcactgtggaagtgccacaggaggatgtgtgataactaattgcaacctgcgagcttctttgggtcccac

SEQ ID NO: 441380 - DNA, 902 bp, Homo sapiens
aaggttttttataactaatttaacagcaaaatctggcctagttatcgtctttattttctttttttaatgtgatttaaaactattcatttgtttcactatagcttaataatttgtttgcttttctgcttctaagaccctgtaggggcattatataacttctggcatttgcatagtacctttacaaaatccaaaaaaatctgaattctaaacacatttagtcctaaaagttacagataagggattctggacttgcgattctaagtctttgttcgtttttattgcattttctgagccaacataaccattatttaaaaacaagttgctatagtaactctacattacagacctcccccaaactcagcagttcagagcatgtattctcactcagggctctgcttccttgtaggtagatgtgtggatcggtgagggcagttcttatttgtatgccttattctggggcccaggctgaaggggcagtggctatccatgataagcttttctcaaggcaccagcagaagtacaagaagtcaaggccaactgcataagcatagttcaaatgtctggttatgccacatctgctaagattgcattgaccaaagcaagtcacatgatcatgcccaaagacttaggagtgggtagtagactgcaaccaccatgcagccaagcaaactacagagccaagcctataacatcactggagagaggtgtattcctcccttggccaggctgggggagggagtgaatattggctgaataataatctaatctaccacagatggttaacagaggtggagtgggatggaaggagaaaaaaaaaaaatcaccaaatgggatgtatcactacccttgctctttttagcgtctgctgctttcacaaagccttttatagggctggagaaatg

SEQ ID NO: 441381 - DNA, 321 bp, Homo sapiens
  misc_feature (279)..(279): n is a, c, g, or t
  misc_feature (292)..(293): n is a, c, g, or t
gccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatacttttccaccatgcctggaatttctgtcactcactgnatacaaccccccnnggttaaggctcccgacgatcctctagat

SEQ ID NO: 441382 - DNA, 178 bp, Homo sapiens
  misc_feature (144)..(144): n is a, c, g, or t
tttcaggttattctcgtcagctccacaaatgggtgctttgtggtctctgcccgcgttacctttcctctcaatgtacctttgtgtgaactgggcagtggaggtgcctgctgcagttaccatggagggtattcagcttggacttancaggctagacgatttaggtcttccagggtaaaaa

SEQ ID NO: 441383 - DNA, 3135 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441384 - DNA, 3237 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatgctgggcacagtggctcacacctgtaatctgccagcactttgggaggccgaggcaggtagatcacctgaggtcaggagttcgagaccagcctcgccaaaatgacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441385 - DNA, 3227 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagagcctgtctgcctcctgctgccatcaacctgctgtctatagctcccatggcacccaggctgttcatgccaaagggtgcctgcaggcccacggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441386 - DNA, 2264 bp, Homo sapiens
gtgcggccaactttaaaggatcccccgaacatgtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441387 - DNA, 3081 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatccttttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441388 - DNA, 2272 bp, Homo sapiens
tcaggtcatgagctgttccagagtatcctcgtaatatggagcaggtagcaatgaagtagtcagctgttagtacccggaagggatgggcagcgtaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441389 - DNA, 1711 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaatcagcgctgtaagatattcgcaagacactgcagcataaaatcattccgcctggtacagtttcccatagaaatctcagaagtacggtcagttatggccttatagctccccctctaaacccacaccatgttcgggggttc

SEQ ID NO: 441390 - DNA, 2848 bp, Homo sapiens
  misc_feature (17)..(17): n is a, c, g, or t
tgagctcggtccggcangatctttgcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttccctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctcagacagtgtatgtattctcgatataacttgtagagtgtgaaatataagtttaactaccaaataaggtctcccagggttagatgactgcgggaagcctttgatcccaacccccaaggctttgtatatttgatcatttgtgatctaaccctggaagaaaaagagctcagaaaccactatgaaaaaatttgttcagtgttttctgtgttcccgtaggttctggagtctgaggatgcaaagatgaataagataaattctcagaatgtagttataatctcttgttttctggtatatgccatctttctttaacttctctaaaatattgggtatttgtcaaataaccacttttaacagttaccattactgagggcttatacattggtgttataaaagtgacttgattcagaaatcaatccattcagtaaagtactccttctctaaatttgctgttatgtctataaggaacagtttgacctgcccttctcctcacctcctcacctgccttccaacattgaatttggaaggagacgtgaaaattggacatttggttttgcccttgggctggaaactatcatataatcataagtttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatagtagcaagtacaggactgtcttgtttttggtgtccttggaggtgctggggtgagggtttcagtgggatcatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatcca

SEQ ID NO: 441391 - DNA, 2099 bp, Homo sapiens
  misc_feature (17)..(17): n is a, c, g, or t
tgagctcggtccggcangatctttgcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttccctagaatcacagctctgactccaaatgactcaatttctcaattagaaaaagtagaagctttctaagcaacttggaagaaaacagtcataatttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatagtagcaagtacaggactgtcttgtttttggtgtccttggaggtgctggggtgagggtttcagtgggatcatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatcca

SEQ ID NO: 441392 - DNA, 2110 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtattgtgcgtgatggggagtccgggcaagccaggaaggcaccgcggacatgggcggccgcgggcagggcccggccctttgtggccgcccgggccgcgaaggcggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccagagctgaggaaggggagggaagcttcaggaaggaaaaggttggcagggattttgagtgttaggcctggtgtagcagaaggaacagaagatttagagcagcgctagccaatagaaataaaatgtgaggcccggggcggtggctcacgcctgtaatcccagcactttgggaggccgcggggcggatccttgagctgaggagttcgagaccagacaacacggcgaaaccccggctctacaaaaaattagctgggcgtgggggcgcgcgcctgtagtcccagctgctcccaagcgaggctgaggcaggagaatcacttgaacccgggagaaggaggttgcagtaagccaagattatgccactgcactgcagcctgggcaaaagagtgagactgtctcaaaaaaaaaaaaaacctgttttgtttttcttttggagaaaaggcatacaaatttattagcatgcagactgggagaaccacaaggtgattatccctattttaaattttctaataaacatactattattt

SEQ ID NO: 441393 - DNA, 2778 bp, Homo sapiens
  misc_feature (17)..(17): n is a, c, g, or t
tgagctcggtccggcangatctttgcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttccctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctcagacagtgtatgtattctcgatataacttgtagagtgtgaaatataagtttaactaccaaataaggtctcccagggttagatgactgcgggaagcctttgatcccaacccccaaggctttgtatatttgatcatttgtgatctaaccctggaagaaaaagagctcagaaaccactatgaaaaaatttgttcagtgttttctgtgttcccgtaggttctggagtctgaggatgcaaagatgaataagataaattctcagaatgtagttataatctcttgttttctggtatatgccatctttctttaacttctctaaaatattgggtatttgtcaaataaccacttttaacagttaccattactgagggcttatacattggtgttataaaagtgacttgattcagaaatcaatccattcagtaaagtactccttctctaaatttgctgttatgtctataaggaacagtttgacctgcccttctcctcacctcctcacctgccttccaacattgaatttggaaggagacgtgaaaattggacatttggttttgcccttgggctggaaactatcatataatcataagtttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatcca

SEQ ID NO: 441394 - DNA, 1767 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtattgtgcgtgatggggagtccgggcaagccaggaaggcaccgcggacatgggcggccgcgggcagggcccggccctttgtggccgcccgggccgcgaaggcggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccaggctgggggagggagtgaatattggctgaataataatctaatctaccacagatggttaacagaggtggagtgggatggaaggagaaaaaaaaaaaatcaccaaatgggatgtatcactacccttgctctttttagcgtctgctgctttcacaaagccttttatagggctggagaaatg

SEQ ID NO: 441395 - DNA, 1825 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtattgtgcgtgatggggagtccgggcaagccaggaaggcaccgcggacatgggcggccgcgggcagggcccggccctttgtggccgcccgggccgcgaaggcggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctg

SEQ ID NO: 441396 - DNA, 1314 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactagacgagttctcgccatattggccaggctgatctcaaactcctgggctcaagtgatcctcccactttggcctcccaaaatacagagattatgggtgtgagccatcatgcccagctggctagatatttcataatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagatgcccagggcccagaagccatcagaattatcagtggagaagcaccttttgactcttcccttccaatgtaatctctgccaacaccatgaggcttaaggtgctctaagtcatgagtgttttggtctcaaatgctgcagttttaataatctgtgactcctgagagcccatggttttttgaccttgtggttctaaaattccttgtctg

SEQ ID NO: 441397 - DNA, 319 bp, Homo sapiens
agtaggtaacttttattagataatatcttgatttttcagggtcactgttataagctaacagtatagcaatgtttttatcgtctttctttggtcatagactcctttgagaatctcttgagaactatgataatgcccagtaaatacacagataagtatttaaggagttcagatactcaaaacccaacaatacagtcaaagcatcctaggttaagacacctcccattaaatacagaataccagcatggaaaggttcaggctgaggttatgattttgtttttgttttttgtttgttttttataagtcatgattttaaaaagaa

SEQ ID NO: 441398 - DNA, 411 bp, Homo sapiens
gggctcaagtgatcctcccactttggcctcccaaaatacagagattatgggtgtgagccatcatgcccagctggctagatatttcatgtaagtggaatcatacattatttctcttttagtgacttgcttattttgcttagcataatgtcctcaaggttcatctatattgtagcatgtgacaagatttcctttttaagggctgaataatattctgtgttatgtatataccacatatctgtgagtagacatttgggttacttccacttcgtggctatactgaataatgctatggtgaaagtggctatgcacatatctgtttgaggtcttgtttgtaattcagttcgtttttatatatactcattggtatttatataaatgggattgctgggtcatatggtagtttaatttttt

SEQ ID NO: 441399 - DNA, 193 bp, Homo sapiens
agcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcc

SEQ ID NO: 441400 - DNA, 780 bp, Homo sapiens
gtgctgtcagccctgctgtcagaccttcttccacagcaaatgagatgtatgcccaaagacggtagaattaaagaagagtaaaatggctgttgaagcactttctgtcctggtattttgtttttgcttttgccacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataaga

SEQ ID NO: 441401 - DNA, 738 bp, Homo sapiens
  misc_feature (456)..(456): n is a, c, g, or t
  misc_feature (731)..(731): n is a, c, g, or t
  misc_feature (733)..(734): n is a, c, g, or t
  misc_feature (736)..(736): n is a, c, g, or t
aagaaaaagaaaattctgtgttggaggtggtaatgtggttggtgatctccattaacactgacctagggcttttgtgtttgttttattgtagaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcncttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataanannanaa

SEQ ID NO: 441402 - DNA, 3776 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtattgtgcgtgatggggagtccgggcaagccaggaaggcaccgcggacatgggcggccgcgggcagggcccggccctttgtggccgcccgggccgcgaaggcggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441403 - DNA, 3120 bp, Homo sapiens
ttgtgtcatcttaagcaagtcactgaacttctctggattcccttctccttttgtaaaataagcatgttatctgtccgtcctgccttgggcattgtgataaggataagatgacattatagaattttgcaaaattaaaagcgctagacaaatgattttatgaaaatataaagattaggttgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441404 - DNA, 3164 bp, Homo sapiens
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcaaaaacaaaaaagaaaaataaaaacaaaaa

SEQ ID NO: 441405 - DNA, 2747 bp, Homo sapiens
  misc_feature (2723)..(2724): n is a, c, g, or t
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcctgcctganntgggatcctctagatcaccatcc

SEQ ID NO: 441406 - DNA, 1884 bp, Homo sapiens
gttttgtgatagcaggtgcagtttgagtactacagtaaacattcagtttcagaacttcttctcttacctgctaaaaccaaagagaaccttttttttatttttacttctgattgttgaacagtcttaaggcagcattaggaagactggcgatttgtgtggagaaatgatggcttgttgttgtctatgcatactttgtgtgtccagtgcttacctggaattttgtctttcccaacagcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagca

SEQ ID NO: 441407 - DNA, 1603 bp, Homo sapiens
  misc_feature (1321)..(1321): n is a, c, g, or t
  misc_feature (1596)..(1596): n is a, c, g, or t
  misc_feature (1598)..(1599): n is a, c, g, or t
  misc_feature (1601)..(1601): n is a, c, g, or t
agagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggcctggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatacctaatctgggagcctgcaagtgacaacagcctttgcggtccttagacagcttggcctggaggagaacacatgaaagaaagaacctcaagaggctttgttttctgtgaaacagtatttctatacagttgctccaatgacagagttacctgcaccgttgtcctacttccagaatgcacagatgtctgaggacaaccacctgagcaatactaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcncttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataanannanaa

SEQ ID NO: 441408 - DNA, 1041 bp, Homo sapiens
cgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 441409 - DNA, 574 bp, Homo sapiens
cgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggacgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 441410 - DNA, 312 bp, Homo sapiens
ccggtttcagagttggattgggctccagcgtgctggccctgtggcttggcgactgtcgcagtctccctgagcggcactctccccactggtccagagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 441411 - DNA, 668 bp, Homo sapiens
cgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggacgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 441412 - DNA, 886 bp, Homo sapiens
gcttgactacactgtgtggagcaagttttaaagaagcaaaggactcagaattcatgattgaagaaatgcaagtgatccacccacctcggcctcccaaagtgctggaattacaggctgagctaccacgcctggacaatttcttaaaaaatttttttaaagtaggattgatagcagatgagttttctcggtgggccaggtcctctgctagggatttcaatggaatgatcccatttaaacccactacaacctcatggggctcttattgtcctcgtcttgtgggggcagagaggaaaagtccccagcatgcagagtgttggaatctggatttgtacacaaagccacgactctgaattgttcaaatcccaagactctcttccccatctctgactctgtcccccaactcttcactctctctggatctctgtctaatcccactccagtgtcctgaccctcctcgagctcaacctttcctcctcctgctaggaccctgccccctcatccctgtgcccttctgtctgggtctctgtccccttgtctgggtgtctgtcaccctccgctctctggttcctcgccttcccgtctctaatctcacagggctgatgtggacgctgctgtatggggggaacacctgccctgctcacagggctctgccacttttcccttccaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 441413 - DNA, 625 bp, Homo sapiens
cgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctaggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 441414 - DNA, 898 bp, Homo sapiens
cgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctaggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 441415 - DNA, 852 bp, Homo sapiens
  misc_feature (292)..(292): n is a, c, g, or t
gctcgtggcgtctgctgtggccccggcccaggtgcctccttgcgcaggctctgtgtagctggtgctccctgtagacacgtctgatggtcctctctgccttccttagtgcgtgtgtgagcgctgcctggagtcctccatgttccgctctcctatgctatcttcgctgacccgaaacatagccactgatagctgtccatgatccgcgcttcgaagatatgttttcccgtgacttcccatggcgtgccgaggtagcagtctcccatctgtagatcgccgctcgtgaccgttgttntcatctgtacgccatgtccgtacctgcctggctagtggttgtataaaggtctctggtcccacatcgtaacttactcgataactatcgtaatagcttattgtgtcggcccggacgctgcattggatacaagctggtcccaagagcagcttgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggtgagccgctgaagcctctctctccg

SEQ ID NO: 441416 - DNA, 768 bp, Homo sapiens
cgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 441417 - DNA, 1568 bp, Homo sapiens
ggcggggccggcgagggctgcctctggggggtccgctagtcgcggggcggcggcggcggctgcgggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacg

SEQ ID NO: 441418 - DNA, 2283 bp, Homo sapiens
cgtggcctatcaatgttgtattttagcttgtgcccgtcggcttacaatttgcaagctgctgggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctactaaaaaaaaaaaaaaaaaatgagtcgggtgtggtggtgtgcacctgtagtcccagctactcaggagttctgagatggaaagattgcttgaacccaggaggcagaggctgcagtgagctgagatcgcgacattgcactctagcctgggtgacagagtgagattccatctcaaaataaataaataaatattaatacatta

SEQ ID NO: 441419 - DNA, 2286 bp, Homo sapiens
ggcggggccggcgagggctgcctctggggggtccgctagtcgcggggcggcggcggcggctgcgggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctactaaaaaaaaaaaaaaaaaatgagtcgggtgtggtggtgtgcacctgtagtcccagctactcaggagttctgagatggaaagattgcttgaacccaggaggcagaggctgcagtgagctgagatcgcgacattgcactctagcctgggtgacagagtgagattccatctcaaaataaataaataaatattaatacatta

SEQ ID NO: 441420 - DNA, 3625 bp, Homo sapiens
tgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctacaaaaaaaaata

SEQ ID NO: 441421 - DNA, 3610 bp, Homo sapiens
tgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacgtatgcctatctccggaaagtccaccttgccccgtccactttcccatctcctcggtataaatcatgtttataagttatggaagaaccgggacattttccagaatctgcaataaaagccataattactatttggatgtaa

SEQ ID NO: 441422 - DNA, 2721 bp, Homo sapiens
tgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttggggtgatgttatcgccccacacagataatggaaaattactttgattcttcccgagtagatacattactgttaaatccctgggatagtttaattactgttaactatcttcctatcttaaaaatgtttaccggtgttagaagaaaattcttgccttcttgctagtgtttttacaggtattggtgcttctgccactcaaagccgttt

SEQ ID NO: 441423 - DNA, 1744 bp, Homo sapiens
gcatctgctcgggcgtatcatcaactgatgagcaagaaggatataattcctacgccctctcacccgatgaacatttggaatagttgttgggcgataaatactatttatccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctacaaaaaaaaata

SEQ ID NO: 441424 - DNA, 2366 bp, Homo sapiens
tgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaaccggatagcttgcccaagctatccggttcaatgtccggagagtatatcgtcgaagaggatagcaattagaaggatctggatgcggttgcttgcgttaggaaatacttgatggcagcttctgtggaacgagggttataatacaggttaaactgcaatagagctacatgttattctaggctactaggtaaaatcagtcgag

SEQ ID NO: 441425 - DNA, 1524 bp, Homo sapiens
tgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggactctaggaatcatcatttctggaagaagcaggccagaggctcccctgtcagaatgtcagcacacatccagtcccctgaagctcagccccttgttcatccagaacacctgagccttcccagtgggctgccatatgagaactatattcatctctgcataaatgaaccatgtatctactcca

SEQ ID NO: 441426 - DNA, 2314 bp, Homo sapiens
tgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttc

SEQ ID NO: 441427 - DNA, 3427 bp, Homo sapiens
tgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctacaaaaaaaaata

SEQ ID NO: 441428 - DNA, 1869 bp, Homo sapiens
cttagtcttcgctttctgaattggagtacgaggataacaaacctcacttctggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctacaaaaaaaaata

SEQ ID NO: 441429 - DNA, 1990 bp, Homo sapiens
tgtctggggctgaggggaggcccggagcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgctatttggatgtatctacaaaaaaaaata

SEQ ID NO: 441430 - DNA, 2094 bp, Homo sapiens
  misc_feature (1504)..(1506): n is a, c, g, or t
  misc_feature (1545)..(1545): n is a, c, g, or t
  misc_feature (1720)..(1720): n is a, c, g, or t
  misc_feature (1740)..(1740): n is a, c, g, or t
  misc_feature (1987)..(1987): n is a, c, g, or t
aaaaagaaatatctgagtctgggtaatttataaagaaaagaggtttcattgagtcatggttctgcaggctgtacaggaagcatgacacaggcatctgctcagtttctggaaaggcctcagggagtgtaccatcatggcagagggggagcaggagcaagagagagagcagggaaataccacacacttttaaatggccccggatctcatgagaactcactcactatcatggggacagtgccaagatgatggtgctaaaccatgcgtgagaaatctgcccctgtgatccagtcacctccaaccagaccccacctccaacactggggactccagttcaacatgagatttgggcaaggacaaatatcgaaactctaccacccccacacccgtgagcacagtcagtttcccttgctgtggggaacttccaaggaaaagctggtgaagcagtcattttaagcttatccaagtacaaaaagaaaataagccatattaacaggctttttaagcagaataatgaaaagtattttgtttaaaaaaaaaatgccaaggaatcagctggagttttgtggacgtggaagtagacttgtgtggattgtgttcggtctgagccaggcagaaatgccgtgaactcaggacatgatagaaatccaggttccagggggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaaggtaggtggacaaaaaatttcctgcccttaaacctcaggacatcagaagacctcacgagattttgtcacttgcacacactttgatgccaaaattctcaaaagggctttcaaaattgtgatgtcagaggcatacaaccacaagccacaggataacatggtgtttcttggagaaggtttaacaagaaaatgaaggaatttagctagcaagcagtttaaaacgctttcacactagggttacctaaccttggtgctattggcatttggggctgaataattctttggtgtggaggctgtcctgtataatgtggtgtgtttaccatcatccttggcctctacccaccagatgccagtagcacacacaaacacaagctcacacacacctttgtccctttgtccagtatgccagtagcacacacaccacaaatgtcttcagaattgcctactatcctggcaggattgggggtgccaaattgccccccaccaagggccactgttttagactatcccacccccagtataatgtgaaaatactagagcatagaagttaacggcctaggctctaaagctagctgtccacgttgaatccaggctctctccttgccagctgtgactttggcctcgttacttgccctctcnnnacttcagtcttttcacttgtaaaatgaggacaaaatatnagtaactgcttcatacagctgctatgaacatttcacagggtaacaaatgtaaagcacctatataacccaggtacttggcaaggaagaattcagtaagttttagctgtcatcgttagtgtcaagtgacctgtcagacatgacctgaagttttaagataaatgatgtcactttacanaaataatgggctgggaatgnagtttctggctcaccccttgtattggtccattcttgcattgctataacgaaatacctgaggctgggtatggtggctcaagcatgtaatcccagcactttgagaggccaaggtgggaggatacgaggtcagcagttcgagacaagcctgaccaacatagtgaaaccccatctctactaaaaatacaaaagaattagccaggcatggtggcacacacctgtaatcccagctactcaggaggctgaggcnggagaaacacttgaaaccaggaggcggaggttgcagtgagccgagattgtgccactgcgctccagcctgaggaacagcgagactccatctcaaaaaagaaaaaaaaa

SEQ ID NO: 441431 - DNA, 472 bp, Homo sapiens
atatatatatttttaatctgttgtacatgtaacagaaacttctggtcatccatcaaaatctatcttccctgtcttctatggtggtagagtttaagctgggtccccagcactccaggtataaacagcattactccggatcccttgcaattcaagttgactctgggacttactttaggccaatgggttatgggtgaaagttgactttccaggtcatctccaatctaagacataagccagtgttcttgagtccctttggttctttttttccatgagctgcaacatggacttctctgcaacccagccttgaccatacaaatgaggacattctctgggggaatggcagaaccgaaagatgtcagagcttgaatcgatgaatgactctgtggagcaaagtaaccttctaacctgggctcttcacttggtactgttacatcagaaaagaataaaattctgtatcatccgtctgccactg

SEQ ID NO: 441432 - DNA, 1179 bp, Homo sapiens
cgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatagatgggggtctcgctatgttgatgaggctggtctcgagctcctggcctcaagtgatcctcccacctcagcctcccaaagtgctgggattacagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatataaaaaaaagtg

SEQ ID NO: 441433 - DNA, 1127 bp, Homo sapiens
ctaatttatataacctaaatgcctataaagtgaagagtgataactttagaatttggggctgttgttgaaactaattcttcaggtttatacttgtgtcttttcttactggtaggaatttatcatacagatacacaaatgcaattcccaggtcaaagcgaacacatttttatgatactgccaaattgccattccaaaagattgtactactttatgttcatacaagaaatcattttcagagtcatctcatagatgtcacctcaggtagagcaggatgactcccattttagggggaacataaatttgtttccggaataagctttcttccccttctcccaggttcggtgtattttcttagctcacctagaagtggcatgattttaggatttgaagcagtatcacttcacttcttaatttgtctgttttgttttctgcttttagacaacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatataaaaaaaagtg

SEQ ID NO: 441434 - DNA, 1085 bp, Homo sapiens
cgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatataaaaaaaagtg

SEQ ID NO: 441435 - DNA, 889 bp, Homo sapiens
cgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatataaaaaaaagtg

SEQ ID NO: 441436 - DNA, 1080 bp, Homo sapiens
  misc_feature (1062)..(1062): n is a, c, g, or t
  misc_feature (1080)..(1080): n is a, c, g, or t
cgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatagatgggggtctcgctatgttgatgaggctggtctcgagctcctggcctcaagtgatcctcccacctcagcctcccaaagtgctgggattacagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgttcttacacatanttataaagataatctgcn

SEQ ID NO: 441437 - DNA, 1465 bp, Homo sapiens
  misc_feature (875)..(877): n is a, c, g, or t
  misc_feature (916)..(916): n is a, c, g, or t
  misc_feature (1091)..(1091): n is a, c, g, or t
  misc_feature (1111)..(1111): n is a, c, g, or t
  misc_feature (1358)..(1358): n is a, c, g, or t
cgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaaggtaggtggacaaaaaatttcctgcccttaaacctcaggacatcagaagacctcacgagattttgtcacttgcacacactttgatgccaaaattctcaaaagggctttcaaaattgtgatgtcagaggcatacaaccacaagccacaggataacatggtgtttcttggagaaggtttaacaagaaaatgaaggaatttagctagcaagcagtttaaaacgctttcacactagggttacctaaccttggtgctattggcatttggggctgaataattctttggtgtggaggctgtcctgtataatgtggtgtgtttaccatcatccttggcctctacccaccagatgccagtagcacacacaaacacaagctcacacacacctttgtccctttgtccagtatgccagtagcacacacaccacaaatgtcttcagaattgcctactatcctggcaggattgggggtgccaaattgccccccaccaagggccactgttttagactatcccacccccagtataatgtgaaaatactagagcatagaagttaacggcctaggctctaaagctagctgtccacgttgaatccaggctctctccttgccagctgtgactttggcctcgttacttgccctctcnnnacttcagtcttttcacttgtaaaatgaggacaaaatatnagtaactgcttcatacagctgctatgaacatttcacagggtaacaaatgtaaagcacctatataacccaggtacttggcaaggaagaattcagtaagttttagctgtcatcgttagtgtcaagtgacctgtcagacatgacctgaagttttaagataaatgatgtcactttacanaaataatgggctgggaatgnagtttctggctcaccccttgtattggtccattcttgcattgctataacgaaatacctgaggctgggtatggtggctcaagcatgtaatcccagcactttgagaggccaaggtgggaggatacgaggtcagcagttcgagacaagcctgaccaacatagtgaaaccccatctctactaaaaatacaaaagaattagccaggcatggtggcacacacctgtaatcccagctactcaggaggctgaggcnggagaaacacttgaaaccaggaggcggaggttgcagtgagccgagattgtgccactgcgctccagcctgaggaacagcgagactccatctcaaaaaagaaaaaaaaa

SEQ ID NO: 441438 - DNA, 926 bp, Homo sapiens
cgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatataaaaaaaagtg

SEQ ID NO: 441439 - DNA, 772 bp, Homo sapiens
cgaccgagcagctccgaggagtccgcccggaaacaaacattccccagggcaatgtcacgacttggtcttcccgaggagccagtcagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgtctgaaaaagtaaaagccattcaaaaatgaaaactatgttcatagtgttgcatattttcacccacaatatgttaataatatttttcttacacatataataaagaatatctggcacatactaggcccttaataaagattttttgaatataaaaaaaagtg

SEQ ID NO: 441440 - DNA, 1323 bp, Homo sapiens
cgaccgagcagctccgaggagtccgcccggaaacaaacattccccagggcaatgtcacgacttggtcttcccgaggagccagtcagaaacagtttgctagatgatgctaaggcccgcttaagaaagtatgatattggaggcaaatattctcacttgccatataacaaatactccgtccttttgccattggtggctaaagaaggaaaactccatttgttgttcaccgtccggtcagagaagctaagaagggcccctggagaagtttgcttccctggaggtaagcgtgaccctacagacatggatgatgcagccacagctctccgggaagcccaggaggaagtgggtctccgtcctcaccaagtggaagttgtctgctgcctggtgccatgtcttattgatagatgggggtctcgctatgttgatgaggctggtctcgagctcctggcctcaagtgatcctcccacctcagcctcccaaagtgctgggattacagacagatacattgataactccatttgtgggtttaatagaccacaacttccaggcccagccgaatcctgctgaagttaaggatgtattcctggtgcctctggcctatttcctgcatccacaggtccatgaccagcattacgtcacacgtcttggtcaccgttttattaatcatatctttgagtacacaaaccctgaagacggtgtcacttaccagatcaagggaatgacggcaaaccttgcagtgttggtggcctttatcattttggaaaaaaaacccacctttgaggttcaatttaatcttaatgatgtattagcatcctctgaagagttattcctgaaggttcataaaaaagctacaagcaggttatgatttactagagcaagagacaaagaactattcacgaggattctgtgtgtgcttattcgtagaacaacaacaatgccagctgttggaatttgacaggtgtgaatattttttctgcagtatgtagttagaatccttgcctcttttccagttgccttctattgttttaggccaatgggttatgggtgaaagttgactttccaggtcatctccaatctaagacataagccagtgttcttgagtccctttggttctttttttccatgagctgcaacatggacttctctgcaacccagccttgaccatacaaatgaggacattctctgggggaatggcagaaccgaaagatgtcagagcttgaatcgatgaatgactctgtggagcaaagtaaccttctaacctgggctcttcacttggtactgttacatcagaaaagaataaaattctgtatcatccgtctgccactg

SEQ ID NO: 441441 - DNA, 560 bp, Homo sapiens
ctaatcgagctcggctaccagttcgacggagactctcgagagtggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagctccgtcgaactggtaccgagcatgatt

SEQ ID NO: 441442 - DNA, 510 bp, Homo sapiens
ctcggtacccagttcgacggagactctctagttcgacggagactctcgagagtggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcagcaagccctccagctcaaccatacacgatcccacattccctgaacatcctctacgtgtccccgtgtaactattcatgcccttgggacgagttactaccgatcc

SEQ ID NO: 441443 - DNA, 607 bp, Homo sapiens
  misc_feature (267)..(267): n is a, c, g, or t
caggaaggagaacgtgggtgggaggctgggttggtgtgacgctctgacctcttccggtgctgacctctccttatcgctacctgaatacagacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgcccccaggaggtcctgccnagagccgagccttgcaccagtgggcgcctggaaggcggggctgggcctgcttttcaccagaggcgcggcaagcacacgaactggagggaaccattcataactaattcagttcccacaagtccacacaaaacttggcggacccgcgaaaactgtgcacaaagcatttcccaatacacccaataggccacgttgttcaacccccaagccttcattggaatttggggcccaagaccgttggggcccaacggttgccataggggttggtaggttcggaaaccccgggagaaggaacacgggggggcggtcttgaaaagggccgtttaccccgagagggagagag

SEQ ID NO: 441444 - DNA, 2670 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaaaaaaaaaaaaaaaaaaaaaaaaaaacccccggggccctataatttagcgggcggcggcggacaaaagcggcggtgaatagagaaatgcgcgcccattggcgccgtcaagagtgttctcctggcacccactttcttctgtgtgtcccacagggtgcggaaaactctctccgcgggctcccccaatatatggaggccgccgcgataattaattcttccataatagccccgccgcggcgttaaaccccgcgcgatctttaggagacttctgccgcgacacagctgtcccaccccgcagctactatcccccgcccgcccctcactttccccaccccgacgacctaaccttcacaccggtcgtctcccgcctattccctgccctggcagcatcccctttttattctgtcgcgccccacactcctccc

SEQ ID NO: 441445 - DNA, 2371 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaaaccaaaaatccaaaaaagaaccaaaaacaaaatcaaccatatgatgcgccagttacaagtcaatggccgtaagtaacctactatgtgtgggtgaaaagaaggtggaaacccaatttaagtctc

SEQ ID NO: 441446 - DNA, 1466 bp, Homo sapiens
taaaatcgagctcggtaccgggtggggagtacggaatcggcaacttccacgcccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441447 - DNA, 1351 bp, Homo sapiens
ctaatcgagctcggctaccagttcgacggagactctcgagagtggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441448 - DNA, 1344 bp, Homo sapiens
  misc_feature (33)..(33): n is a, c, g, or t
atcagctcggcccagtttacggagactctcganagtggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441449 - DNA, 1375 bp, Homo sapiens
  misc_feature (45)..(45): n is a, c, g, or t
aatttgggggcaaataaccggagtaggtttgttcctgtgccttgncgagtcgcggcctgctgggaatggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441450 - DNA, 1361 bp, Homo sapiens
ctcggtacccagttcgacggagactctctagttcgacggagactctcgagagtggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441451 - DNA, 1212 bp, Homo sapiens
aggactctgtgctctggaggctgcgagctgaccagatggtcgtcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441452 - DNA, 964 bp, Homo sapiens
tagcgacgccagaggaccccgttacgctcagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441453 - DNA, 965 bp, Homo sapiens
ggggtgctcagaggatccccgtcacgctccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441454 - DNA, 1922 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagaggcggctggccgcttcacagagccgcacccacgaggacctctacatcatccccatccccaaccgcat

SEQ ID NO: 441455 - DNA, 2319 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcataaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441456 - DNA, 2224 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcaggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441457 - DNA, 1775 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagcctttgacccccttcgctctcccacagcagggctctcagctgccagccaacctcgtgc

SEQ ID NO: 441458 - DNA, 710 bp, Homo sapiens
tgagggacgaaaacaaaggattttagagagcatcctatatcaaccctcttgaaacaagaggaaagcaggaaaaggaaggaaaaagatcttccaaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441459 - DNA, 754 bp, Homo sapiens
cgcaacctgcggcccatgcgggagcggactgctgtccagggccagtacctgacagtggagcagctcacactagacttcatgctgcacaccaagtaccaggtggtctaccccttccccaccttccagcccgccttccagctcaagaaggaccaggtggtgctgctcaacaccagctactcccggtgggaagtcgacttcccaccgggggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441460 - DNA, 1429 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttacgacgagcagtctgaagcctgcatgcctgccagtctgagatctagaagatactcaatcacacacaacgccacatga

SEQ ID NO: 441461 - DNA, 527 bp, Homo sapiens
  misc_feature (205)..(205): n is a, c, g, or t
ggccaaaaaaaaaaaaaaaaactataataacataatactaccgttctcggtctcatttgtgcgaagagaagaggttcaaaacaccaaagtaagactgacacctccacagaagtaccacatatcatggagaaaaaaagaggagtctacaagagaaaaaaacaaacaaaaaacccaccaccaaaaatttttttctagtttggtgggnccaccacccaacaactaacccaacctaacaaaatagcattccctaacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441462 - DNA, 962 bp, Homo sapiens
  misc_feature (840)..(840): n is a, c, g, or t
  misc_feature (878)..(878): n is a, c, g, or t
  misc_feature (882)..(882): n is a, c, g, or t
  misc_feature (887)..(887): n is a, c, g, or t
  misc_feature (889)..(889): n is a, c, g, or t
  misc_feature (892)..(892): n is a, c, g, or t
  misc_feature (897)..(897): n is a, c, g, or t
  misc_feature (955)..(955): n is a, c, g, or t
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgcccccggactcctgaangcgcgagctgccccgggcactggcaaggaaggccgctncccncaaananaancagcngcctctccctctaaacctcctccctggacgagccgggcctttcccccccgcgtgtcancaatttg

SEQ ID NO: 441463 - DNA, 711 bp, Homo sapiens
gtttccctgactttttaatgattgccattctaactgttgtgagatggtatctcattgtggttttgatttgcatttctctgatagccagtgatgatgagcattttttcatgtgtgtttggctgcataaatgtcttcttttgagaagtgtctgttcatatcctttgcccactttctgatggggttgtatgtttttttcttgtaaatttgtttgagttcattgtagattctggatattagccctttgtcagatgagtaggttgcgaaaattttctcccattttgtaggttgcctgtttactctgatggtagtttcttttgttgtgcaaaagctctttagtttaattagatccccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441464 - DNA, 924 bp, Homo sapiens
  misc_feature (752)..(752): n is a, c, g, or t
  misc_feature (767)..(767): n is a, c, g, or t
  misc_feature (855)..(855): n is a, c, g, or t
  misc_feature (871)..(871): n is a, c, g, or t
  misc_feature (920)..(920): n is a, c, g, or t
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcaggaaagcaacttttggnccaaaaaattcggangaacccgggaggccacccaagttgggggggggccaaaaggaatggaaaaggggtccaaattggggggggcggccccccccgggggaangggaattggccccccnggggcctttgttgggcccccccaaagggggcttttccctgggccccaanaaaa

SEQ ID NO: 441465 - DNA, 2364 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441466 - DNA, 1977 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgagggtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441467 - DNA, 2045 bp, Homo sapiens
  misc_feature (2023)..(2023): n is a, c, g, or t
  misc_feature (2025)..(2025): n is a, c, g, or t
  misc_feature (2040)..(2040): n is a, c, g, or t
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagcacgaagggggatgacananatcctctagagtcancccaa

SEQ ID NO: 441468 - DNA, 2212 bp, Homo sapiens
  misc_feature (2192)..(2192): n is a, c, g, or t
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgtctccgtcgaacttctcaggtgatccgcctgcctcagccttcccaagtgttgggattacaggcatgagtcaccaagtcccgccatagatcttttttttttttcttaaccacctgacatatctttatttactgcctacaaacctgtatagatccctttctatagtataagcactaagtttagtgcaggaactttgttttacttgctactcaacctcccctagtatagaacagtgcaaaaatacctagtgaatattttttggatgaaaaaattacctagaatttttaaaaagatgaataaagttatacattggaagaaatggcattcataataactccaaatgagtggttaaacgaagtatgatttgataaactacanctgagagtctccgtcgaact

SEQ ID NO: 441469 - DNA, 1000 bp, Homo sapiens
agctcgcacccggagaggatccgcaccccccggacttgctctctgatgaagggcatgtcgttcagtgccccagcagtcagaagcagttcttgtggaactaaaacgaataatgttaccctcacaaaggaaatgttcttttactaagttattgctgattcttgaatgtctgttatataactgggtcggctatcaaggaggtgccctctggctagcttgagaggaaggacgatggacgacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccaaaaaaaaaaaaaagacatcatggccaactggtaggttcctaagtctccttccatccagtcaagccatgatgtcttttcttctttttcttttttttaacaaaacagaacaaaaccaaaaaatgtccagaa

SEQ ID NO: 441470 - DNA, 1814 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcaggcacaagtgtccaagctacggtcaggttatagctctggccatgacttataaatttggctctggtaacacttgtaccttgtatgcgctagcaactgca

SEQ ID NO: 441471 - DNA, 1573 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagctccgtcgaactggtaccgagcatgatt

SEQ ID NO: 441472 - DNA, 1014 bp, Homo sapiens
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtggtaaggacctccgatgcacaaatgtgcatgtgcatagacacacacacacacatgccccctgccccccacatgcacgcacccacacacaccatcaccaccagatctggggcgtgttcattcagcacacattctagggtgactactgtgtgcaaggtgcaactagtgtgagtcatcaggacccagagaaagca

SEQ ID NO: 441473 - DNA, 566 bp, Homo sapiens
  misc_feature (424)..(424): n is a, c, g, or t
  misc_feature (426)..(426): n is a, c, g, or t
  misc_feature (429)..(432): n is a, c, g, or t
  misc_feature (434)..(439): n is a, c, g, or t
  misc_feature (441)..(444): n is a, c, g, or t
  misc_feature (458)..(458): n is a, c, g, or t
  misc_feature (464)..(464): n is a, c, g, or t
  misc_feature (469)..(470): n is a, c, g, or t
  misc_feature (563)..(563): n is a, c, g, or t
ggtataaagtccgggggagccggtcccgggcagccgctcagccccctgcccctcgccgcccgccgcctgcctgggccgggccgaggatgcggcgcacgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagccagcncncgnnnncnnnnnncnnnncttctccttcctcntcctcncactnnctctcatcaccatgcggcacaaaaggtcacaatagcccatgtcccccgcaaatgcacccctctaataaaaaacggcaccatacccaatcacancat

SEQ ID NO: 441474 - DNA, 609 bp, Homo sapiens
agaataggcatacactgtgactttaggaagaactctcacaaaatcagaggttgccctatgtaatatcacactttttaccttgagcaggtggatagcctgggagttcttgttatacctcaatcttggtccattctatttgttcccctgtccttcagcagtgcccttaggcttgctttaaacattaacagcattcataaggcatggtttctagggtcagagcccagcctccctccacccacccggctccctacacaccttgacagtgctcctttgagatgcctcagttctagtctcccttgtaattgtgcacagtagatgtctgaacaaatagaccagagtcctgcaaaagtgatcttgaaatcacaattaaaagagactttggagagatctactcaggaaaattttctgaatagacaaatgcttttaaagggggttctagacagtccgtcttttctgcctccttctgcgaagtagggctacactaaaaccttgtcacaatgtgacctgagcaaaaccattatcaagtgatttagttgtcttgaaccagacaaaagaaaattgacatgatttcaagataggtttagaaaaataatctgactagcaaaaaaa

SEQ ID NO: 441475 - DNA, 2087 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441476 - DNA, 2048 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatgtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441477 - DNA, 2034 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgtctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441478 - DNA, 1524 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggagctcatctgttcccttgacttctctttttccagttcttcggcaaggccacaggtgcagttcttacagaccttcctctttttcccttcaccacaagaagcagcccgcagagaagctggatctggcttcttcaaatcttctggatccagcaactcatctgagtcaatgagatacatgctgtcgtcctccatatcagttggctgagagggtccacagcttggcagcagcagggtccac

SEQ ID NO: 441479 - DNA, 2291 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgtgcatcttctgtggatgtagtttaactcaccgttggcctcttgagcatgtggtcaggttgaacatgatgatcaaccaaaaggaggacagggtggacaccttctttaccctggactccaagtttcctctcgaagcctgcagtcactttagcttttcattagcagagaccacgactgtatcactcattgctttgaacactctccaggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441480 - DNA, 2252 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatgtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgtgcatcttctgtggatgtagtttaactcaccgttggcctcttgagcatgtggtcaggttgaacatgatgatcaaccaaaaggaggacagggtggacaccttctttaccctggactccaagtttcctctcgaagcctgcagtcactttagcttttcattagcagagaccacgactgtatcactcattgctttgaacactctccaggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441481 - DNA, 2019 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaatgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441482 - DNA, 1488 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactggtgagtgctggggtgactggagcctgccatgctgcctccagtggcttcatgctgaagacatcgcggtgctgtactatttttagaacatacattttccaggctgggcaacacagggagaccatctctgcaaataattaaaaaaaaaaaaaaattagccaggcatggtggtatgtacctgtggtcccagctacttgggaggcaaaggcaggaggatcacttgagcctgggaggtcgaggctgcagtgagccgtaattgtgccatgtatctaatttcactctccctcaaaaccctaccagtaagccactattgtgccactgcactccagcatgggcatcagagcgagaccttggtgtcttcacatttgtttttataaatggatgggaaggattgtagaaagttaatcagtgatgttcatcatcagcgttaatcatcagtgttttttaaatgtaaaagctgccagcatttacaaatcaggaaatttcaagtgaaaacacagatttttttcccttctgttcttgaatttggaaaatatggcaatctgggtccactttccccagcatgataaccagctgaagcttgagtagtggctgccctct

SEQ ID NO: 441483 - DNA, 1807 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441484 - DNA, 1498 bp, Homo sapiens
  misc_feature (60)..(60): n is a, c, g, or t
cagatgtgtaagcgtcccgatgttattcatcacagggcgggcttcgatgttatggagagnagccgggagcgagcccaggcggcagtcttgattcccttttggccagcagttttgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441485 - DNA, 1884 bp, Homo sapiens
  misc_feature (60)..(60): n is a, c, g, or t
cagatgtgtaagcgtcccgatgttattcatcacagggcgggcttcgatgttatggagagnagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgtgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441486 - DNA, 1355 bp, Homo sapiens
agcagcctctcatattgctgctgtctgcctggcctataggcttctgagttatgacactggtgtgaagagaaaaggcttaaagcacattttggcactgttaggatttgggatttctgggtggtgacaattctcgttcattagttactgattttcccgcagcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441487 - DNA, 820 bp, Homo sapiens
gcggccgcctactactactactgctcgaattcaagcttctaacgatgtacggggacatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441488 - DNA, 770 bp, Homo sapiens
agccgggagcgagcccaggcggcaggtgagagtggtgggggccagctgagcgccagagctccctcaactgtcccctcccggcccaccctcgttcccacatcctctcattttctcttcccaccccgttcctcgatgggaacgcagccacggccgccccgctgaaagccccggctggtttattcctgagaagtcggtgtgaggggccagggccggccctaacctccctggggtcctgactgggaatttctgccgttccccggctgcctcgtcccttgcgtagccggccctactctgaggccccggggacaccacgctgaggagaaacggctccgagcttgggatcggggagacctggttctgagacccggtcctaccagtagccaatcattgtgaccttgggcctcagtccccgtgacgttttggtccctgggggttcctggcagcaaagcacgaaagccttggagtcggggggtacctgagctcacgattgtaatttcgaacctgcaacttgtccgaacccccagcgtgttgagttgatataattaagtatccagatcggaaggatgcttgttactagaacagacagctaggcctttgtccagaaggattgattgagtgggtctgtgtgtggtccaggaatctcattttaaccactccctcgggtgatttgtaggatctgcaagttcgggaaaggctggtgcccttcattctgacattactgagtgccaagctctggatggctcaaggaggtcacggtctagccactaaca

SEQ ID NO: 441489 - DNA, 556 bp, Homo sapiens
tgcccccaacccccaacatgtgtatattctctacacattgctggccagtcatacagctttttctcatgtaaatttgtttctaattcctttgcatcctagtgcatcttctgtggatgtagtttaactcaccgttggcctcttgagcatgtggtcaggttgaacatgatgatcaaccaaaaggaggacagggtggacaccttctttaccctggactccaagtttcctctcgaagcctgcagtcactttagcttttcattagcagagaccacgactgtatcactcattgctttgaacactctccaggatctcattgactcagatgagctgctggatccagaagatttgaagaagccagatccagcttccctgcgggctgcttcttgtggggaagggaaaaagaggaaggcctgtaagaactggtgagtgctggggtgactggagcctgccatgctgcctccagtggcttcatgctgaagacatcgcggtgctgtactatttttagaacatacattttccaggctgggcaacacagggagaccatctctgcaaataatta

SEQ ID NO: 441490 - DNA, 1701 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttg

SEQ ID NO: 441491 - DNA, 2051 bp, Homo sapiens
  misc_feature (12)..(12): n is a, c, g, or t
  misc_feature (42)..(42): n is a, c, g, or t
ccgtacgggatnaaattacggctaggtacgaggcctgggtgntgcaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441492 - DNA, 2082 bp, Homo sapiens
  misc_feature (60)..(60): n is a, c, g, or t
cagatgtgtaagcgtcccgatgttattcatcacagggcgggcttcgatgttatggagagnagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441493 - DNA, 1971 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441494 - DNA, 1836 bp, Homo sapiens
tcgtcgctccgtggagcctcctcctctcgcgagagcgcgaggcgtggagtcgacggctggagagaagccgggagcgagcccaggcggcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441495 - DNA, 1935 bp, Homo sapiens
  misc_feature (12)..(12): n is a, c, g, or t
  misc_feature (42)..(42): n is a, c, g, or t
ccgtacgggatnaaattacggctaggtacgaggcctgggtgntgcaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaaaaagatt

SEQ ID NO: 441496 - DNA, 1692 bp, Homo sapiens
tcgtcgctccgtggagcctcctcctctcgcgagagcgcgaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgtgcatcttctgtggatgtagtttaactcaccgttggcctcttgagcatgtggtcaggttgaacatgatgatcaaccaaaaggaggacagggtggacaccttctttaccctggactccaagtttcctctcgaagcctgcagtcactttagcttttcattagcagagaccacgactgtatcactcattgctttgaacactctccaggatctcattgactcagatgagctgctggatccagaagatttgaagaagccagatccagcttccctgcgggctgcttcttgtggggaagggaaaaagaggaaggcctgtaagaactggtgagtgctggggtgactggagcctgccatgctgcctccagtggcttcatgctgaagacatcgcggtgctgtactatttttagaacatacattttccaggctgggcaacacagggagaccatctctgcaaataattaaaaaaaaaaaaaaattagccaggcatggtggtatgtacctgtggtcccagctacttgggaggcaaaggcaggaggatcacttgagcctgggaggtcgaggctgcagtgagccgtaattgtgccatgtatctaatttcactctccctcaaaaccctaccagtaagccactattgtgccactgcactccagcatgggcatcagagcgagaccttggtgtcttcacatttgtttttataaatggatgggaaggattgtagaaagttaatcagtgatgttcatcatcagcgttaatcatcagtgttttttaaatgtaaaagctgccagcatttacaaatcaggaaatttcaagtgaaaacacagatttttttcccttctgttcttgaatttggaaaatatggcaatctgggtccactttccccagcatgataaccagctgaagcttgagtagtggctgccctct

SEQ ID NO: 441497 - DNA, 1557 bp, Homo sapiens
ttccccagggctacatctgcacgccccgtggtgtcaccctcagccggcgccgggcaccctggacagtgcggtgggcgatggcccaggtgggtggccgcgacggtggcctcctgcagagctgggacccggtcctacattcgtgattttgttttctcccaagtcagaaaaatgttgagggtattagacatccctgaaactcagttaaccgaatttccagtctccaaagcggaagggtaggcatcgccaggcgctggtgagccctggtcaatgagcgcttccatggaaaccgctcggctgattacattttttctgtgtattatttgaatagagagtaaagctcctccgctgtttcgtaaccatatcctttcccccgctaactggaggctgatttctacatatttcttccatgtatctgagaatatctaactagaaggatgagaaggaaataaaatgttataatcagataaggctggttataaaagagtaatgtattacctcaatttttgactgactttgtaaaagccaataactggtttaatgtttatcttgatagactttaaatgtatcaagtcttaattgtattttaaattgaagccttacatttttaaaacagattttgtatttttcttgtggaggtctttgctctaataacacacacacactgtctctctctctctctctctctaattctaggcacacatttagttagatgtgaagcatttaattcattgggagctaggtcagctgccagatgagttgcaaaaacagaaaaaaacctacccattgaataacttctttgaatttggagataagttttcttttacttaaaatgaatatattaattctagaggggcaaaactagcaatgcttatgcaagtgacggtgctgctcttgttccacccccacccagatggtctctgagtgcgccgtcctgggcagggcacacggtctggagctgagagggtggagcaagagtgcactgactccgagccgagggcaggagtggctcaacttggtctcgtcttgcacttagtgcaaataccaataattaagatgcctagacttctgcccttggtcacagtaacaacaacattttgaagacttttccctggtggcatcctagagggaccgactttctgcagcctctgtcttccaagctgagcttctgctgcagtgtggctgtcactgcacctgtgtgtctccctgacgtccctgtcagctgcttcattttgatttcctttcttctcccgccctttctgtaggctctgtcccagcatctcctgttcttaactggccacaatacaacactaagcgcatttttagtaatttgtatttattaaatagagtttgtgggccttgttctctactttaaaagcagatgagtggaacatttatgtttccctggtcaatgagcctcaataaaaaacaaacagaaaaaaggttttacacgtgacacatgatatcttttcattgctgttaaggacattttgagaaagttttctaagtcgctatgctccaatttcttaatgcttaaataaaagagaaattcagtgactt

SEQ ID NO: 441498 - DNA, 1503 bp, Homo sapiens
ttccccagggctacatctgcacgccccgtggtgtcaccctcagccggcgccgggcaccctggacagtgcggtgggcgatggcccaggtgggtggccgcgacggtggcctcctgcagagctgggacccggtcctacattcgtgattttgttttctcccaagtcagaaaaatgttgagggtattagacatccctgaaactcagttaaccgaatttccagtctccaaagcggaagggtaggcatcgccaggcgctggtgagccctggtcaatgagcgcttccatggaaaccgctcggctgattacattttttctgtgtattatttgaatagagagtaaagctcctccgctgtttcgtaaccatatcctttcccccgctaactggaggctgatttctacatatttcttccatgtatctgagaatatctaactagaaggatgagaaggaaataaaatgttataatcagataaggctggttataaaagagtaatgtattacctcaatttttgactgactttgtaaaagccaataactggtttaatgtttatcttgatagactttaaatgtatcaagtcttaattgtattttaaattgaagccttacatttttaaaacagattttgtatttttcttgtggaggtctttgctctaataacacacacacactgtctctctctctctctctctctaattctaggcacacatttagttagatgtgaagcatttaattcattgggagctaggtcagctgccagatgagttgcaaaaacagaaaaaaacctacccattgaataacttctttgaatttggagataagttttcttttacttaaaatgaatatattaattctagagggccagatggtctctgagtgcgccgtcctgggcagggcacacggtctggagctgagagggtggagcaagagtgcactgactccgagccgagggcaggagtggctcaacttggtctcgtcttgcacttagtgcaaataccaataattaagatgcctagacttctgcccttggtcacagtaacaacaacattttgaagacttttccctggtggcatcctagagggaccgactttctgcagcctctgtcttccaagctgagcttctgctgcagtgtggctgtcactgcacctgtgtgtctccctgacgtccctgtcagctgcttcattttgatttcctttcttctcccgccctttctgtaggctctgtcccagcatctcctgttcttaactggccacaatacaacactaagcgcatttttagtaatttgtatttattaaatagagtttgtgggccttgttctctactttaaaagcagatgagtggaacatttatgtttccctggtcaatgagcctcaataaaaaacaaacagaaaaaaggttttacacgtgacacatgatatcttttcattgctgttaaggacattttgagaaagttttctaagtcgctatgctccaatttcttaatgcttaaataaaagagaaattcagtgactt

SEQ ID NO: 441499 - DNA, 517 bp, Homo sapiens
ctcaccttcctagaatatcaggaaatgcctgaggcataacagatagtaagcctaaaaatgacccaagaccggacgtagtctgtggcgtgcagtgtaatggagtttgtggtcagcgttcaggttatggcgagagcggtacccataaccttccaccctttttgttgggaatgaatgacgggagtctgcacccgcccccaccccatggtgcagagtggcttgtcagaccctccatagaatagagacaggcttcaaagactatttagtacttattagcagtttttaccctttttatcatgattcatgtggtagagcaagctcgcctgacacctttataatggagtacttcagtataagattagtgccccagagatactcagagttcaagagcaatgcagcctccctgttttggtaggttgttagcgaggctgttgtgggaggggagggcctgtagatggaatgatttgtaagctgggaaaggaaaaaatctaggtttttctttttttggaccatcactggg

SEQ ID NO: 441500 - DNA, 2152 bp, Homo sapiens
  misc_feature (891)..(891): n is a, c, g, or t
gggccatgaatttaaggtgaaaccagtcagctgagttagttgtgtgatttttttttttctcctagcaacattcagctgttatgagggcagcgaagagcaggcaggtgatcagttcacccaaaattcgtgttttgccctgcaggtttgacagaggagaagcagtgccagaggcttgagagtagttgcaagggggtgattttgatgatgaaccttgaaatgttagctgagtaggaaagcaagagaagaatcagagtgggggccatgaaaatcattactggcttaaagtgagttaatgggcgcagagtttcagtttgggaagatgaaaaatttctaaagctggatagggctcttggtttcacagcaatgtgaatgtatgtaatgccactcaaccaaacacttttaaatatttaaaattcagtaactctatagagaaataaagggttttcccaatcctggaaaaaaatggttaaaattgtaaatcttacatatattttaccatagtaaaaaatgaattaggctgggcccatggctcacgcctacaatcccagcactttgggaggctgaggcaggcaaatcgtttgaggccaggagttcaaaaccagcctggccaacatggcaaaactcatctctactaaaaatacaaagaaaatagccaggcatggtggcacacacctgtaatcccagctactcaggaggctgaggcatgagaattgcttggacctggaaggcagacattggagtgagctgagatcttcccactgcactccagcctgggtgacatagctagactgtctcaaaaaaaaaaaaaaaaagaatgaacacttaaatatttgtggcagatagaggtgttatttgcatatggaagaaaattgctttagaaatgaaatttcngattactgaaactaaagagaaagtatctcttcttatcatggtaccaagcttgagggtgcataagtcacctatagacagaaataagcattgagtttcattttttgtttgtttttgagacaggttctcactgttacccagcctggagtgcagtggtacaattgtagctcactgcagcctggacctcctgggatcaagggattcccccaacctcggcctcccaagtagctgggactatagaaatgcaacaccatgcccagataatttaattttttttttttttttttttttttgtagagacaggggtttctctttgtcacccaggctggcctcaaactcctgggctcaagcagtcttcccacctttccctcccaaagtgctgggattacaggcgtgagccactgcatcctgccgagaaaatcattttttatttaaataatgtcaaatggaagtatgtagcacccccccccaccttcttttcccctttctttcctctttgagtctgctgtcattccctttttcatgagttttctctgctccccaaataggctaaacaataaccgtaaagtgagattagagaaaataagaatggagtagatgatggaattcaaaatagctgtctacattcttcactgagaaagatagctttgagttaaaggtgagaggagcaaatctggggaaaaacgggtgaaacggcatgatttaagtagcataccagatgcgtttctgcatggcatggctcttgcttgatgaataatgttctgtatagtagaagaggaaaatacagtgagtgaaggagctggcagaaggtgggctgggggagttggggaagagtgaaatgagtatggagaggtgagagagctgactgcaaaggcatgtggggtgtggattttaaaaggaaagccctgaggtggaaatcactaacatggtgcctggctacaagcagagggagctcaggacttgactgtgctgggggtggcctgcccttttgtagtgcagttgaggagagctcaggggctgtcagaatgctgtgtgggaaggtggaggatgaaagaggacctgggagcagcaactttgttctggtttgttgttttctcttccctacctcgtatgtactcccactcaggaaaagatcctgagacctctctgtaccagatcctcttatacccaggttctccttaatcccaatcaactttaatctataaagttacgatttgtttacttataaatttatttttaataaagttgtgaaaccgaacatgtt

SEQ ID NO: 441501 - DNA, 2481 bp, Homo sapiens
  misc_feature (891)..(891): n is a, c, g, or t
gggccatgaatttaaggtgaaaccagtcagctgagttagttgtgtgatttttttttttctcctagcaacattcagctgttatgagggcagcgaagagcaggcaggtgatcagttcacccaaaattcgtgttttgccctgcaggtttgacagaggagaagcagtgccagaggcttgagagtagttgcaagggggtgattttgatgatgaaccttgaaatgttagctgagtaggaaagcaagagaagaatcagagtgggggccatgaaaatcattactggcttaaagtgagttaatgggcgcagagtttcagtttgggaagatgaaaaatttctaaagctggatagggctcttggtttcacagcaatgtgaatgtatgtaatgccactcaaccaaacacttttaaatatttaaaattcagtaactctatagagaaataaagggttttcccaatcctggaaaaaaatggttaaaattgtaaatcttacatatattttaccatagtaaaaaatgaattaggctgggcccatggctcacgcctacaatcccagcactttgggaggctgaggcaggcaaatcgtttgaggccaggagttcaaaaccagcctggccaacatggcaaaactcatctctactaaaaatacaaagaaaatagccaggcatggtggcacacacctgtaatcccagctactcaggaggctgaggcatgagaattgcttggacctggaaggcagacattggagtgagctgagatcttcccactgcactccagcctgggtgacatagctagactgtctcaaaaaaaaaaaaaaaaagaatgaacacttaaatatttgtggcagatagaggtgttatttgcatatggaagaaaattgctttagaaatgaaatttcngattactgaaactaaagagaaagtatctcttcttatcatggtaccaagcttgagggtgcataagtcacctatagacgtagagattgtagtataggacctgggaatattacattatttgctcccatgtttactgttttgttctaagcctttagcacagcattcaaaacaagttgagcactcagtaaacatttgctgactcagtacttggagaacctaggtagagtagaatgatgggaatcaaaaggaaaacagtattctgttagagatcagcaatatcttacactagtagagggatctgtgagaaaaagaatcaagaccattgaatgtgtggcggcttatagcatttgacattctgatctgtgcacgtgatgagaaaaaaagtctgattacagaacagggaaggagagaaataagcattgagtttcattttttgtttgtttttgagacaggttctcactgttacccagcctggagtgcagtggtacaattgtagctcactgcagcctggacctcctgggatcaagggattcccccaacctcggcctcccaagtagctgggactatagaaatgcaacaccatgcccagataatttaattttttttttttttttttttttttgtagagacaggggtttctctttgtcacccaggctggcctcaaactcctgggctcaagcagtcttcccacctttccctcccaaagtgctgggattacaggcgtgagccactgcatcctgccgagaaaatcattttttatttaaataatgtcaaatggaagtatgtagcacccccccccaccttcttttcccctttctttcctctttgagtctgctgtcattccctttttcatgagttttctctgctccccaaataggctaaacaataaccgtaaagtgagattagagaaaataagaatggagtagatgatggaattcaaaatagctgtctacattcttcactgagaaagatagctttgagttaaaggtgagaggagcaaatctggggaaaaacgggtgaaacggcatgatttaagtagcataccagatgcgtttctgcatggcatggctcttgcttgatgaataatgttctgtatagtagaagaggaaaatacagtgagtgaaggagctggcagaaggtgggctgggggagttggggaagagtgaaatgagtatggagaggtgagagagctgactgcaaaggcatgtggggtgtggattttaaaaggaaagccctgaggtggaaatcactaacatggtgcctggctacaagcagagggagctcaggacttgactgtgctgggggtggcctgcccttttgtagtgcagttgaggagagctcaggggctgtcagaatgctgtgtgggaaggtggaggatgaaagaggacctgggagcagcaactttgttctggtttgttgttttctcttccctacctcgtatgtactcccactcaggaaaagatcctgagacctctctgtaccagatcctcttatacccaggttctccttaatcccaatcaactttaatctataaagttacgatttgtttacttataaatttatttttaataaagttgtgaaaccgaacatgtt

SEQ ID NO: 441502 - DNA, 2480 bp, Homo sapiens
cgcggtagagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctgaatgatcaggatgagatttaatgcccatatcttaccagttcagttatctccagagccatttcaccctttagagtgagtcacatgcagggagtgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgtttta

SEQ ID NO: 441503 - DNA, 2512 bp, Homo sapiens
cgcggtagagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctgaatgatcaggatgagatttaatgcccatatcttaccagttcagttatctccagagccatttcaccctttagagtgagtcacatgcagggagtgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgttttaatgtttctgaccaaatttataaccacaaaaac

SEQ ID NO: 441504 - DNA, 2322 bp, Homo sapiens
cgcggtagagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagatacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctgaatgatcaggatgagatttaatgcccatatcttaccagttcagttatctccagagccatttcaccctttagagtgagtcacatgcagggagtgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgtttta

SEQ ID NO: 441505 - DNA, 2426 bp, Homo sapiens
cgcggtagagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctgaatgatcaggatgagatttaatgcccatatcttaccagttcagttatctccagagccatttcaccctttagagtgagtcacatgcagggagtgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgtttta

SEQ ID NO: 441506 - DNA, 2179 bp, Homo sapiens
cgcggtagagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcatgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgtttta

SEQ ID NO: 441507 - DNA, 793 bp, Homo sapiens
cgcggtagagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtccgccgttccgtggacctgacacgccggggcagggctgtttacagcccaaagggggatacaactcacacgtccagggcacctggggccccacttgggccccccgcgccgggtgccgacccccccagattggggcccgccgcgcc

SEQ ID NO: 441508 - DNA, 2656 bp, Homo sapiens
cgcggtagagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagaggcagaggaaccccgtgccccgcccctttcctgtcatctcagacgaacgcagcgacatcctgaggaaggcgcatcacaataggggataaggtggtgggcagcctccctctgggtgaagaggagtgagaccccactaacgtgctgcgtggttttatgttgtaaccattttacgtgtggttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctgaatgatcaggatgagatttaatgcccatatcttaccagttcagttatctccagagccatttcaccctttagagtgagtcacatgcagggagtgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgtttta

SEQ ID NO: 441509 - DNA, 2011 bp, Homo sapiens
cgcggtagagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttctacacttaaattaaatgcagagttatatatagttggactctataaatgg

SEQ ID NO: 441510 - DNA, 1086 bp, Homo sapiens
ttgctgatacaatcgagctcggtacccaggtcttttcccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgcgtttcactatccgaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtgccaagtccta

SEQ ID NO: 441511 - DNA, 4462 bp, Homo sapiens
cgcccgcggacagtccactccgcggggactttctctggataaggacctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgacatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctatactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgcgtttcactatccgaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtgccaagtccta

SEQ ID NO: 441512 - DNA, 4363 bp, Homo sapiens
acgcctccagtgcagctcagtcgacttagagatcccctcttcattgtaaagggaggagagcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgacatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctatactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgcgtttcactatccgaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtgccaagtccta

SEQ ID NO: 441513 - DNA, 1234 bp, Homo sapiens
cgcccgcggacagtccactccgcggggactttctctggataaggacctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgctgcctcttggaagaaagtccttgtcctttgagactcagaaggccccaagctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaataaaaacattttttaaacagcatgaaaacatacc

SEQ ID NO: 441514 - DNA, 743 bp, Homo sapiens
acgcctccagtgcagctcagtcgacttagagatcccctcttcattgtaaagggaggagagcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtgtaagtcaagggtagccatgaaaactg

SEQ ID NO: 441515 - DNA, 4511 bp, Homo sapiens
gtccagccaaggaaagtgaagcaagcagacttgtttgggtcaaggttgcctagggaagcggagcacttaagtgcctctttttccccttctccagcctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgacatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctatactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgcgtttcactatccgaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtgccaagtccta

SEQ ID NO: 441516 - DNA, 1147 bp, Homo sapiens
cgcccgcggacagtccactccgcggggactttctctggataaggacctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgaagcttattgagactcacctgagaactattccaagtcatgcattttctaatctgcccaatatttccagaatctacgtatctatagatgtgactctgcagcagctggaatcacactccttctacaatttgagtaaagtgactcacatagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctattcctaatgagtccatggagacttactgcacctggatctgtgttcaaagactccaaagacctgaaagtgaagactagctcctgggacactgaagctgagaactccagacccaaatgatacttatgactccacccttggttcactgtatctttttggacacaacatcccttatttctttgtctgaattttagtatctgcccgcttcataaaaatgctttgagaattgaaaccagcttctgaatcacctggagag

SEQ ID NO: 441517 - DNA, 427 bp, Homo sapiens
gctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgtgagtacccgggagagatcagggtaggacccagagatcaagggcatctgcagaggtggcccgaagtgcacaaaagcagctcaataacagcccgaagtagtgtgtgagtgtgtgtatgtgtgagtgaatgtctgtgtgtgtagatgtgtgtgtgtgctaa

SEQ ID NO: 441518 - DNA, 6197 bp, Homo sapiens
gagatttttgcattggatatgagatcagattgacttttaaggtctcgtctgactctttgcctttcaagttttgatcagaagtctcagctttttttctccaggtttagatttaacaatctaaacctagttctaacattgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaagtggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 441519 - DNA, 3909 bp, Homo sapiens
cacgttgtgtgaggaatgtggagtgtttactgtcccgttactccacctccgtggtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 441520 - DNA, 6213 bp, Homo sapiens
gagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaagtggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggaaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 441521 - DNA, 1650 bp, Homo sapiens
atgatctgcaggtgatctaaggatcccggcacgagcgccagtcatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 441522 - DNA, 1166 bp, Homo sapiens
agttcgacggagtactctccacgtggggttaccacactggagagattttccttctctcttaatggaaaatctctccagtgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 441523 - DNA, 267 bp, Homo sapiens
aggactcgacattgtccacagatgtactggccattacatgaaacaagaaaccaagcatctttgctgttgttaattattatatgtgccattgttacaggagattataggctagtctgtaataaattatcttatagcagcctttggggtttggtaattctgctaatgtgtggaaagccatggaaatgactgtcctttataatggtagattttggcctaatggtcctttgctgcttcacactcctccacccccatacctgacagccagtg

SEQ ID NO: 441524 - DNA, 6357 bp, Homo sapiens
gagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaagtggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 441525 - DNA, 6414 bp, Homo sapiens
gagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaagtggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 441526 - DNA, 5904 bp, Homo sapiens
gagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaagtggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 441527 - DNA, 808 bp, Homo sapiens
ggcggttgctggggcttgcgtgggaggaaggtgactgtgaggaaggtgtgtgtccaccgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacaga

SEQ ID NO: 441528 - DNA, 727 bp, Homo sapiens
ggtgaggaaggtgtgtgtccaccgagcacttggattcagcttcttcatttccaacatggaagaaacttacaaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagaaaacaaaaccaaacaaaataaaaaaacatgggagaagacaaaggaacaccaaaga

SEQ ID NO: 441529 - DNA, 859 bp, Homo sapiens
  misc_feature (814)..(817): n is a, c, g, or t
  misc_feature (825)..(825): n is a, c, g, or t
gtgtgttaatgatggctatgcaccatcatttgcacgccctcgtaactaagcggcagattttaatgactaatatttgacagtggaattatgtgattccatctttacgggacgactttactttatacacgagtttgtattatattttgttcgtataattgcgacgagagttcaaggttctatttcttagtactcgatatggatcatatacggtgatatataaaaataagctattactttaccccttaatctcaactaaccaaccgccgggaggctaagcccttacttcgaggttagacatgttatacggggcggggcgataaatagatattctttcctctttccattcccgcgtccactgtagttgggttctctgtccgaaagtgatgttgtatattgataggcgtcgattatacaggggtgtatacaaaagagaggcaagcgtttcatctcctacgaaacagcgcagcccatttcagcggtgcaatttagcgccataagcagactctggcttcaggcatatgagttcccgatctccactcgtatgttcttccatgggctaccaaggtcaatgcacagtagattaatccctgtttcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagacccgcctgtaaaaaaaaaaannnntggcctcnttgtgaagtcaagcttaataaagacacgacgtcc

SEQ ID NO: 441530 - DNA, 306 bp, Homo sapiens
actttaaaacgtttctccctggatacttgcatttcccaaaaaatgaagtcaccaaattatatgtcaaaaggcttgatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacaga

SEQ ID NO: 441531 - DNA, 716 bp, Homo sapiens
ggcggttgctggggcttgcgtgggaggaaggtgactgtgaggaaggtgtgtgtccaccgagcacttggattcagcttcttcatttccaacatggaagaaacttacaccacattttttttttcttaaatatcacctgggagtgtgttggaaatggacaatctcagcgctcatcccagacctactgaatcagaatcagcactttaacacagtccctaagtgatgtaacacctggagaccgactccctggaccctgagaagctattgcaatgcccctatgacaaaaaccatcaaatcagggcttgcaggtttccttatcatcttatcaagtgcagaaaggtagggtcataatttgccctctaacaccctcctgagttcttttaaaaggccatattttataaatatcaaataattttatcatgttttaattgattgccagaattgttttgggaatctacctctcttaaataccaacatttatagaaaggcatttgttcattccttaggataaattttttcttgttttggttttcttcccattaactagtgacaaagaaccctttataaacagcatctctagagtcttctcaccctttgtaaaacagactaattttggctaacaatgagaaatcctgcctatcttctaaatttgatgtattcatgagcctaacaatgattgagtgctataactcactttttctgattattttgtttagaaa

SEQ ID NO: 441532 - DNA, 1202 bp, Homo sapiens
ggcggttgctggggcttgcgtgggaggaaggtgactgtgaggaaggtgtgtgtccaccgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagaaaaacaacaaaaaacacaacaaaaaaaaaacaaacaacaacaaaaacctgtcggcgcaagcacacccaacaaaaaacacaacaaggacagaatcatcaaaacataacaactagagtacgggcaggcggcgaggcgcaccacacgcagacgagacgacaacaacaggatcacaacgacctgcctcccggagacgacatagccgggcagcagaaaccaccgcggccgggaagagatcccgcacacgcaaataaagaactcaccccacgggcgggagaaaaacccagacacgttgattaccatgcgaaacaaagacagaagaacggcggaacaccacaagcggggccatagaagaaagggcacccactaaaccagcaaggagagagacacgcgccgc

SEQ ID NO: 441533 - DNA, 836 bp, Homo sapiens
ggcggttgctggggcttgcgtgggaggaaggtgactgtgaggaaggtgtgtgtccaccgagcacttggattcagcttcttcatttccaacatggaagaaacttacaccacattttttttttcttaaatatcacctgggagtgtgttggaaatggacaatctcagcgctcatcccagacctactgaatcagaatcagcactttaacacagtccctaagtgatgtaacacctggagaaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacaga

SEQ ID NO: 441534 - DNA, 637 bp, Homo sapiens
agagaactgacagatcccttaattttggttccacagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacaga

SEQ ID NO: 441535 - DNA, 650 bp, Homo sapiens
ggcggttgctggggcttgcgtgggaggaaggtgactgtgaggaaggtgtgtgtccaccgagcacttggattcagcttcttcatttccaacatggaagaaacttacagttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacaga

SEQ ID NO: 441536 - DNA, 960 bp, Homo sapiens
ggcggttgctggggcttgcgtgggaggaaggtgactgtgaggaaggtgtgtgtccaccgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagagattgcttaatagtttggtcaagtacctgcagccccaagatcagagatcatgtccaattccacattaatgaaccataatgatttaaagttttcttaaaggttctaactgaaatagacaggaaacttgggttagaaaaggtaactgtgtattt

SEQ ID NO: 441537 - DNA, 923 bp, Homo sapiens
ggcggttgctggggcttgcgtgggaggaaggtgactgtgaggaaggtgtgtgtccaccgagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagagattgcttaatagtttggtcaagtacctgcagccccaagatcagagatcatgtccaattccacattaatgaaccataatgatttaaagttttcttaaaggttctaactgaaatagacaggaaacttgggttagaaaaggtaactgtgtattt

SEQ ID NO: 441538 - DNA, 987 bp, Homo sapiens
tgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggatagattctacctttgtcacccaggcgggagtgcagtggcatgatctcggctcactacaacctccgcatcctgggttcaagcagttctcctgtctcagcctcccgagtagctgagattacaggcatgtgccaccaggcatggctaatttttgtatttttagtggagacagggtttcactctattaggctggtctggaactcccgacctcaggtgatccacgtgcctttgtctcccaaagtgctgggattacaggcatgagtgacggtgcccagccattcgtgacatgtttatacaaatataactttagcaaatatttagcataactatcaaaattacaaatcatattaaatttgtataaatgtatgcaatttttggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttg

SEQ ID NO: 441539 - DNA, 374 bp, Homo sapiens
gaggcaggagaatggcgtgaacccgggaggcagagtttgcagtgagccgagatcccaccactgcactccagcttaggcgacagagccagactgtgtctcaaaaacaggaaagaaaacaaaagaaaatttggactattgccaattacaaatatttttagagaagaattcaaaacagtaactgtggatgatggaaacaatagttatgataaaagtctgatgaaacttcccagttcacaaggaaatttaattacttatgtgcagcattttaagacagtaatcagaatcatgactgacagcatcatatcagggccagcagacttttataaatttcatacaatcttcagaaataataacttttttttttttttttggat

SEQ ID NO: 441540 - DNA, 3074 bp, Homo sapiens
  misc_feature (9)..(11): n is a, c, g, or t
aaacatttnnnggatgggacaacttgtatttgtccctttcgcttccacgtccaaacccctttaagaaggatgaatgggcaggatgagttagactccttcgctgtatcgtctactgattcttaaaatgtgacaaatctgattggacgacttacatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441541 - DNA, 1186 bp, Homo sapiens
  misc_feature (9)..(11): n is a, c, g, or t
aaacatttnnnggatgggacaacttgtatttgtccctttcgcttccacgtccaaacccctttaagaaggatgaatgggcaggatgagttagactccttcgctgtatcgtctactgattcttaaaatgtgacaaatctgattggacgacttacatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcct

SEQ ID NO: 441542 - DNA, 3027 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatattatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441543 - DNA, 3027 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441544 - DNA, 3027 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagcctcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441545 - DNA, 2060 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgcattaaactttaaagacattttacaatgaatggatatgaattgatatagcgtcttaacaatagtaggggatttgctattgtcaaactggctcttataaagaattgacttgtaagggagcggttgtg

SEQ ID NO: 441546 - DNA, 2976 bp, Homo sapiens
aaccgtaggccgaggtgccttatggtgctactggtagattatagttgtacgtgatgccaggcccgtcaaccagcgatgcaatggatcatggcaaggtgcaggaatattttcgtattgacagagagtaggatccagcgtgattagcgagctgcgagtttcatcttctagtaggagcgcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441547 - DNA, 1512 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatatta

SEQ ID NO: 441548 - DNA, 2937 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441549 - DNA, 3081 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441550 - DNA, 947 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcct

SEQ ID NO: 441551 - DNA, 3140 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaagctgttgagatgtgtttacttatacttcagaacattaaaagtttaaaaactggtatt

SEQ ID NO: 441552 - DNA, 3184 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggtaagacgagcgcgctggccgggaggccgcggcgaggcgagaaaagccccccgcacggccccgggagtgaggccgccattttaacctgattttggcctccaaggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441553 - DNA, 2889 bp, Homo sapiens
gtaggctgttctagaggatcccaatcagttacatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441554 - DNA, 2835 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgta

SEQ ID NO: 441555 - DNA, 1193 bp, Homo sapiens
cgctgcctgggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcct

SEQ ID NO: 441556 - DNA, 915 bp, Homo sapiens
ggcgcgcgcgcttccggcccgagccggaagctccgactgcggcggcatccgggacggcgggcgggctggccaccacgggacaggaaggcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaat

SEQ ID NO: 441557 - DNA, 1368 bp, Homo sapiens
ggcgcgcgcgcttccggcccgagccggaagctccgactgcggcggcatccgggacggcgggcgggctggccaccacgggacaggaaggtgagatccgggacctcagctttgcaagcaggctccgccggcgaccgctgacgggcgctgggctcgcggcgctgcaaggcggcgaggcccgggcctggcgccgcctgcgcagccttggtcgcggcgtgccggcgctgcagcgcggcagggggcggggccggccgcccggaggcccaagtggcggggacgcctccctgccgggtcaggttctcagagcgggtctccggcggcggcgacgggggccgggccgcgcgtgacccgccgcagtcacgccgttcttaatcactagtagctggtgctccaggctggcggcgctcacctttctcctagccgggtgacccaggggatttattttatgttggctttctctgaaatgccaaagccacccgattattcagagctgagtgactctttaacgcttgccgtgggaacaggaagattttcgggaccattgcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaat

SEQ ID NO: 441558 - DNA, 2437 bp, Homo sapiens
gaagatttgaacagtgtaaattccagagttgagaaagcatttagcatggtggaaatgtggagagcttattggtgagagaggatggagctaagagaaataagatcaaatattaaaattaggaatttaggcattacctcagggaaaagccttgacagtgaaaagaaactacttaatcgctaatagctagtctggaccagacacttaactgcgctttgggaatcatcctgggctaatcaggaaataaacttgacttttctatttttctctgaagctttacaggacatactcccactcccatttttttctaagcctacagcatcttgattcatagtataattcctgaagtatgctgaatggactttttaaggttcctttagcatttttgtatagagttatatgtgatctttctataaccatgccattcacttaaataattcatgaagggaatggtttaatttaaaggaagacctaataggaagaagattaaaggaagcttttagtcagcctgtggctagatttattgatttggtgatcaaacctgtgctatttcctgaatttcagctaatggccaactgtggtcaaagaatggctttcagttaaagttttgacttcttattataaataatataaagaatgtctcagtaattagaaatcccttaataagtagaacaaatgtggcaagtaggactcctatcggtatacaaattccatttctttttataagaaaaacacataaaccattatcatttattcatgagccaaagccattaagaagataaatccagttatcagcttcctgtctctgaagtttggatcattttatagatccacgcaatagagagcttccttcctatgaaacaaaaaccttgagatctctttttttttgagacagagtctcgctgttgtcagcccaggctggagtgcaatggcgcaatctcggttcactgcaacctctgccttccaggttccagcaattctcctacctcagctcccaagtagctgagatgacaggcgtgtgccaccacgcccagctaatttttgtatttttagtagcgatggtgtttcactacattggccaggctggtctcgaactcctgacctcaggtgaccacccgcctcagcctcccaaagtgctgggattacaggcatgagccactgtgcccggccaagatctaactcacgcttacttttcattaaaatatttcttgtcgcttttagctattgtcagaatccaataaacagcttacgcattcattttggtaaagcaaatttcacaggaaaatagacaaaattataagagattcctggagacaacacaaggaaaacaatgtttaaaagcaaaatagcctgtgtaatgttaggtaatgtaatgcccaagtgaataaaagatttttcgtcaagcaaactactgtttctactttgggggaaaaaagtcagttttacatttgtaatttaaggaaagaacagaaagcacaaaggtttttcttttctttattaatggcctactagaaatgagcagtgcaagagtctacctgtactattctaatacagtaagatattggacacaaaatggaggtaactttttaaaatagattggcttggaagttgaaatgtagattaatggatataacccaatagaaagggattttcaaataaaaccaaagtctatttttttatttactttctaattttgaacagatgactcagtcctaaatctttgcctttatttcctataaaatgtaggtgatacttgtaactcgacttcctggagttaattcttcagcaagaggtgaccctgggagcgtactttaaaataattgctgtacagccattgagtactaacatgatgataggttttcaaaatatctttgtagtggatgctgcataattacattcacttctcttagactgtaaaagactttcttgacttgttttaacagtagagatagcagtacaatttgaatttatggtttaggctctgcaattagaggaacaattgcagtttcctcctacccttcatatggtctgtgtaaaactgatgtttgcttaacttattttaaaagttgattacgttttcagaaaataaagataatcacttttgccatggttataatcaaatctaagctttcagacttgagagccatggtgtaaaactcaaggaggtttatttaaattatgctgactttgctagaattggataaattctgtataagccaagtatgagttcacatgtactcgaatatacagttttcacaaagctattactctcatcagtcaggcttgtatgatctattccttaccacaaaagaagtagacaattgccacttttatttctaatccttaagttgaatgtttcttcttggatgtaagttcaaataaattgatctggataaattttcatttctacttaattaaaacttcctatgtaaaatccaaa

SEQ ID NO: 441559 - DNA, 2375 bp, Homo sapiens
gaagatttgaacagtgtaaattccagagttgagaaagcatttagcatggtggaaatgtggagagcttattggtgagagaggatggagctaagagaaataagatcaaatattaaaattaggaatttaggcattacctcagggaaaagccttgacagtgaaaagaaactacttaatcgctaatagctagtctggaccagacacttaactgcgctttgggaatcatcctgggctaatcaggaaataaacttgacttttctatttttctctgaagctttacaggacatactcccactcccatttttttctaagcctacagcatcttgattcatagtataattcctgaagtatgctgaatggactttttaaggttcctttagcatttttgtatagagttatatgtgatctttctataaccatgccattcacttaaataattcatgaagggaatggtttaatttaaaggaagacctaataggaagaagattaaaggaagcttttagtcagcctgtggctagatttattgatttggtgatcaaacctgtgctatttcctgaatttcagctaatggccaactgtggtcaaagaatggctttcagttaaagttttgacttcttattataaataatataaagaatgtctcagtaattagaaatcccttaataagtagaacaaatgtggcaagtaggactcctatcggtatacaaattccatttctttttataagaaaaacacataaaccattatcatttattcatgagccaaagccattaagaagataaatccagttatcagcttcctgtctctgaagtttggatcattttatagatccacgcaatagagagcttccttcctatgaaacaaaaaccttgagatctctttttttttgagacagagtctcgctgttgtcagcccaggctggagtgcaatggcgcaatctcggttcactgcaacctctgccttccaggttccagcaattctcctacctcagctcccaagtagctgagatgacaggcgtgtgccaccacgcccagctaatttttgtatttttagtagcgatggtgtttcactacattggccaggctggtctcgaactcctgacctcaggtgaccacccgcctcagcctcccaaagtgctgggattacaggcatgagccactgtgcccggccaagatctaactcacgcttacttttcattaaaatatttcttgtcgcttttagctattgtcagaatccaataaacagcttacgcattcattttggtaaagcaaatttcacaggaaaatagacaaaattataagagattcctggagacaacacaaggaaaacaatgtttaaaagcaaaatagcctgtgtaatgttaggtaatgtaatgcccaagtgaataaaagatttttcgtcaagcaaactactgtttctactttgggggaaaaaagtcagttttacatttgtaatttaaggaaagaacagaaagcacaaaggtttttcttttctttattaatggcctactagaaatgagcagtgcaagagtctacctgtactattctaatacagtaagatattggacacaaaatggaggtaactttttaaaatagattggcttggaagttgaaatgtagattaatggatataacccaatagaaagggatcctaaatctttgcctttatttcctataaaatgtaggtgatacttgtaactcgacttcctggagttaattcttcagcaagaggtgaccctgggagcgtactttaaaataattgctgtacagccattgagtactaacatgatgataggttttcaaaatatctttgtagtggatgctgcataattacattcacttctcttagactgtaaaagactttcttgacttgttttaacagtagagatagcagtacaatttgaatttatggtttaggctctgcaattagaggaacaattgcagtttcctcctacccttcatatggtctgtgtaaaactgatgtttgcttaacttattttaaaagttgattacgttttcagaaaataaagataatcacttttgccatggttataatcaaatctaagctttcagacttgagagccatggtgtaaaactcaaggaggtttatttaaattatgctgactttgctagaattggataaattctgtataagccaagtatgagttcacatgtactcgaatatacagttttcacaaagctattactctcatcagtcaggcttgtatgatctattccttaccacaaaagaagtagacaattgccacttttatttctaatccttaagttgaatgtttcttcttggatgtaagttcaaataaattgatctggataaattttcatttctacttaattaaaacttcctatgtaaaatccaaa

SEQ ID NO: 441560 - DNA, 2377 bp, Homo sapiens
gaagatttgaacagtgtaaattccagagttgagaaagcatttagcatggtggaaatgtggagagcttattggtgagagaggatggagctaagagaaataagatcaaatattaaaattaggaatttaggcattacctcagggaaaagccttgacagtgaaaagaaactacttaatcgctaatagctagtctggaccagacacttaactgcgctttgggaatcatcctgggctaatcaggaaataaacttgacttttctatttttctctgaagctttacaggacatactcccactcccatttttttctaagcctacagcatcttgattcatagtataattcctgaagtatgctgaatggactttttaaggttcctttagcatttttgtatagagttatatgtgatctttctataaccatgccattcacttaaataattcatgaagggaatggtttaatttaaaggaagacctaataggaagaagattaaaggaagcttttagtcagcctgtggctagatttattgatttggtgatcaaacctgtgctatttcctgaatttcagctaatggccaactgtggtcaaagaatggctttcagttaaagttttgacttcttattataaataatataaagaatgtctcagtaattagaaatcccttaataagtagaacaaatgtggcaagtaggactcctatcggtatacaaattccatttctttttataagaaaaacacataaaccattatcatttattcatgagccaaagccattaagaagataaatccagttatcagcttcctgtctctgaagtttggatcattttatagatccacgcaatagagagcttccttcctatgaaacaaaaaccttgagatctctttttttttgagacagagtctcgctgttgtcagcccaggctggagtgcaatggcgcaatctcggttcactgcaacctctgccttccaggttccagcaattctcctacctcagctcccaagtagctgagatgacaggcgtgtgccaccacgcccagctaatttttgtatttttagtagcgatggtgtttcactacattggccaggctggtctcgaactcctgacctcaggtgaccacccgcctcagcctcccaaagtgctgggattacaggcatgagccactgtgcccggccaagatctaactcacgcttacttttcattaaaatatttcttgtcgcttttagctattgtcagaatccaataaacagcttacgcattcattttggtaaagcaaatttcacaggaaaatagacaaaattataagagattcctggagacaacacaaggaaaacaatgtttaaaagcaaaatagcctgtgtaatgttaggtaatgtaatgcccaagtgaataaaagatttttcgtcaagcaaactactgtttctactttgggggaaaaaagtcagttttacatttgtaatttaaggaaagaacagaaagcacaaaggtttttcttttctttattaatggcctactagaaatgagcagtgcaagagtctacctgtactattctaatacagtaagatattggacacaaaatggaggtaactttttttttcaaataaaaccaaagtctatttttttatttactttctaattttgaacagatgactcagtcctaaatctttgcctttatttcctataaaatgtaggtgatacttgtaactcgacttcctggagttaattcttcagcaagaggtgaccctgggagcgtactttaaaataattgctgtacagccattgagtactaacatgatgataggttttcaaaatatctttgtagtggatgctgcataattacattcacttctcttagactgtaaaagactttcttgacttgttttaacagtagagatagcagtacaatttgaatttatggtttaggctctgcaattagaggaacaattgcagtttcctcctacccttcatatggtctgtgtaaaactgatgtttgcttaacttattttaaaagttgattacgttttcagaaaataaagataatcacttttgccatggttataatcaaatctaagctttcagacttgagagccatggtgtaaaactcaaggaggtttatttaaattatgctgactttgctagaattggataaattctgtataagccaagtatgagttcacatgtactcgaatatacagttttcacaaagctattactctcatcagtcaggcttgtatgatctattccttaccacaaaagaagtagacaattgccacttttatttctaatccttaagttgaatgtttcttcttggatgtaagttcaaataaattgatctggataaattttcatttctacttaattaaaacttcctatgtaaaatccaaa

SEQ ID NO: 441561 - DNA, 599 bp, Homo sapiens
gccctacaccacatacaagctgagagtggtggcacacaacgaggtgggcagtacggcttccgagtggatcagtttcaccacccaaaaagaattgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaaccttctttttccaggtcatctgcacgactgacgaaggaagtgttaagacgccgttgatccaatatgatacctctactggacttggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatgg

SEQ ID NO: 441562 - DNA, 932 bp, Homo sapiens
gagcgttctagagtatcccagctatctaagagtcccgggcttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctctttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaaaaaaaaaa

SEQ ID NO: 441563 - DNA, 1355 bp, Homo sapiens
gtcctgtacattgttcagctgcatctctgtcctgtacccataaggtgccagtagcacttctccagtggtgacaaccaaaaatgtctttggatattgtcaaatgtctcctgatgggccaaaatcatccccagttgggaatcgctgttatgtgatagctcatttcattctcactttgaccctgtgaacatggggttattatgaatcaggtgtcattgagatcaggatcaggagcggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctctttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaaaaaaaaaa

SEQ ID NO: 441564 - DNA, 988 bp, Homo sapiens
gaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctctttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaaaaaaaaaa

SEQ ID NO: 441565 - DNA, 901 bp, Homo sapiens
gagcgttctagagtatcccagctatctaagagtcccgggcttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctctttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaaaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaaaaaaaaaa

SEQ ID NO: 441566 - DNA, 5411 bp, Homo sapiens
cttacttacaaaaacaggtggctggctcagactgtagtttgctaaccctgagaacttgacagcaaaaagaagagataaatagtagttaaaacataaagcagaatcaaataaattttttttccatataggtgagatctgataatgtttttaggtagaaaggaagaaacttgtgaagcaggagagactaaacctgtttgatgtttttggttgggggccaggttagagataggatcgggtgtatgtgttgttgaattattcctaaaagggaagagagacaccagtaattgcaaaatcatcaagtatttatagaggtagaggagaaagaataaattcagatgtgttgagatagatgagagtacctatgaggatttgtttgatttgggaaaatgaaagcagaagtaggagaagcagaagtaggagaaattcagatgtgttgagatagatgagagtacctatgaggatttgtttgatttgggaaaatgaaagcagaagtaggagagggcagaggataattggaagcttagaatggggaaaggatgtctgtgctgtggggaatactttcaggcagttgttaccagtattttgaagatgacaacttgtttaacctcgaaacaatttgtggaccaccccatgattgtagttacatttttagtattcatcaatggagaatatgcatattagaaaaaagctactactcagttctctcttagatgactttgtattttattaaccacaacatggactgcacatttgaaaaatgttaatacatgtatgtgagaaattgtctttatgtaatgcaatgccctgggtacccactgagataactaatttaacagcttcccaggaggctgaaagctcataagttagaaatcattgcgttctaatgaatcaacaataagagaataaaggattgcttagaagtagtattctgtcaaaattaaaatgaacttataatgaactcactttgaaggattccataactttttattcagtagtacttggcagttttgagcaagatgacagaaacaaaatgatctagggttaggcataacattgtatagaaggccagaataaacatttagcttattctttctctaaattaccttttcctgagatcacacccagtttcattaatcacttctgtatttatggtgatcaaattggcatctcattttcttaaccgttttgttgatttcatgttccccatttacaccttactgaatatttccatttgggtatcttactgtttcacatttaacctactgaaaagaaagcttcttatctttcctttgaaacgagctctctgctgatttctacttggagtagagaatatacagagatgctgaagttgatgggaaaatgtggataggttgggaaaaacatgaattaggtgtgggattcattgaagaaattgaacagcatcatgactggtaaatgatggtgatgagaaagtagagaaaacctactgtttgctcttaccatttgttttttaaattttagccaaatcaagttcttgactcatacactcttacaaatattcaaatatatgttctctattttgtttccttaatccaataatgttgtaatccttttccaattaataagcaatatgttcaataccgatgcccatttaagtgtgctgttactctctaatcattattattcctttcataaatagatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcatctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactcgtgtgtgtgtgtgtgtgtgtgtgtgtgtgtgtgtgtgcatacagacacacatatttctgaaatgtaaatattctctttttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaa

SEQ ID NO: 441567 - DNA, 5963 bp, Homo sapiens
cttacttacaaaaacaggtggctggctcagactgtagtttgctaaccctgagaacttgacagcaaaaagaagagataaatagtagttaaaacataaagcagaatcaaataaattttttttccatataggtgagatctgataatgtttttaggtagaaaggaagaaacttgtgaagcaggagagactaaacctgtttgatgtttttggttgggggccaggttagagataggatcgggtgtatgtgttgttgaattattcctaaaagggaagagagacaccagtaattgcaaaatcatcaagtatttatagaggtagaggagaaagaataaattcagatgtgttgagatagatgagagtacctatgaggatttgtttgatttgggaaaatgaaagcagaagtaggagaagcagaagtaggagaaattcagatgtgttgagatagatgagagtacctatgaggatttgtttgatttgggaaaatgaaagcagaagtaggagagggcagaggataattggaagcttagaatggggaaaggatgtctgtgctgtggggaatactttcaggcagttgttaccagtattttgaagatgacaacttgtttaacctcgaaacaatttgtggaccaccccatgattgtagttacatttttagtattcatcaatggagaatatgcatattagaaaaaagctactactcagttctctcttagatgactttgtattttattaaccacaacatggactgcacatttgaaaaatgttaatacatgtatgtgagaaattgtctttatgtaatgcaatgccctgggtacccactgagataactaatttaacagcttcccaggaggctgaaagctcataagttagaaatcattgcgttctaatgaatcaacaataagagaataaaggattgcttagaagtagtattctgtcaaaattaaaatgaacttataatgaactcactttgaaggattccataactttttattcagtagtacttggcagttttgagcaagatgacagaaacaaaatgatctagggttaggcataacattgtatagaaggccagaataaacatttagcttattctttctctaaattaccttttcctgagatcacacccagtttcattaatcacttctgtatttatggtgatcaaattggcatctcattttcttaaccgttttgttgatttcatgttccccatttacaccttactgaatatttccatttgggtatcttactgtttcacatttaacctactgaaaagaaagcttcttatctttcctttgaaacgagctctctgctgatttctacttggagtagagaatatacagagatgctgaagttgatgggaaaatgtggataggttgggaaaaacatgaattaggtgtgggattcattgaagaaattgaacagcatcatgactggtaaatgatggtgatgagaaagtagagaaaacctactgtttgctcttaccatttgttttttaaattttagccaaatcaagttcttgactcatacactcttacaaatattcaaatatatgttctctattttgtttccttaatccaataatgttgtaatccttttccaattaataagcaatatgttcaataccgatgcccatttaagtgtgctgttactctctaatcattattattcctttcataaatagatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcatctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactcgtgtgtgtgtgtgtgtgtgtgtgtgtgtgtgtgtgtgcatacagacacacatatttctgaaatgtaaatattctctttttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaaaaaaaaaacaaaacaacaaaaaaacaaaaaaacacacaagaataaaaagaacaaacaaaaacagaaaaaaaaaggagaaacacataaggaatacagaatggcaaaaaaaaacaagatacaagaaatggcacaagcgcccaataagaaaaaacaaacaaaaagaaaatggccatcaaaaaaaacaaaagcaagcgaacatgcaccagaacccaaggaaaacagacaaaaagcgaggtagacctgggacaaacccacaaagaaagaaacaaggacaaccaaccagaaagacagacagtaaacaagagatacataagagataaaaaatgaagcgcaaacaccaaacaacaaggagagaacagaaaaaaacgcagaaaagaagagtcgagacgcgcagagacacacagaaaaacgcgaagcgaaacgcacgaagaagagaagagaagagagcacaaacgagagaaggagccgagacaggaaacgacggagagccgacacagacacacagacaaccagagcgaacgagaaagaacagaaacgaatacaaaaaaagg

SEQ ID NO: 441568 - DNA, 3873 bp, Homo sapiens
gcctgtactcccagttactcgggaggctgaagccggagaattgcttgaacccgggaggcagaggttgcggtgagccgagatcgcgccattgcactgcagcctgggcaacaagagcgaaactccatctcaaaaaacataaaatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcatctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactcgtgtgtgtgtgtgtgtgtgtgtgtgtgtgtgtgtgtgcatacagacacacatatttctgaaatgtaaatattctctttttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaa

SEQ ID NO: 441569 - DNA, 4203 bp, Homo sapiens
cttacttacaaaaacaggtggctggctcagactgtagtttgctaaccctgagaacttgacagcaaaaagaagagataaatagtagttaaaacataaagcagaatcaaataaattttttttccatataggtgagatctgataatgtttttaggtagaaaggaagaaacttgtgaagcaggagagactaaacctgtttgatgtttttggttgggggccaggttagagataggatcgggtgtatgtgttgttgaattattcctaaaagggaagagagacaccagtaattgcaaaatcatcaagtatttatagaggtagaggagaaagaataaattcagatgtgttgagatagatgagagtacctatgaggatttgtttgatttgggaaaatgaaagcagaagtaggagaagcagaagtaggagaaattcagatgtgttgagatagatgagagtacctatgaggatttgtttgatttgggaaaatgaaagcagaagtaggagagggcagaggataattggaagcttagaatggggaaaggatgtctgtgctgtggggaatactttcaggcagttgttaccagtattttgaagatgacaacttgtttaacctcgaaacaatttgtggaccaccccatgattgtagttacatttttagtattcatcaatggagaatatgcatattagaaaaaagctactactcagttctctcttagatgactttgtattttattaaccacaacatggactgcacatttgaaaaatgttaatacatgtatgtgagaaattgtctttatgtaatgcaatgccctgggtacccactgagataactaatttaacagcttcccaggaggctgaaagctcataagttagaaatcattgcgttctaatgaatcaacaataagagaataaaggattgcttagaagtagtattctgtcaaaattaaaatgaacttataatgaactcactttgaaggattccataactttttattcagtagtacttggcagttttgagcaagatgacagaaacaaaatgatctagggttaggcataacattgtatagaaggccagaataaacatttagcttattctttctctaaattaccttttcctgagatcacacccagtttcattaatcacttctgtatttatggtgatcaaattggcatctcattttcttaaccgttttgttgatttcatgttccccatttacaccttactgaatatttccatttgggtatcttactgtttcacatttaacctactgaaaagaaagcttcttatctttcctttgaaacgagctctctgctgatttctacttggagtagagaatatacagagatgctgaagttgatgggaaaatgtggataggttgggaaaaacatgaattaggtgtgggattcattgaagaaattgaacagcatcatgactggtaaatgatggtgatgagaaagtagagaaaacctactgtttgctcttaccatttgttttttaaattttagccaaatcaagttcttgactcatacactcttacaaatattcaaatatatgttctctattttgtttccttaatccaataatgttgtaatccttttccaattaataagcaatatgttcaataccgatgcccatttaagtgtgctgttactctctaatcattattattcctttcataaatagatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcatctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaa

SEQ ID NO: 441570 - DNA, 1070 bp, Homo sapiens
  misc_feature (3)..(3): n is a, c, g, or t
  misc_feature (41)..(41): n is a, c, g, or t
  misc_feature (69)..(69): n is a, c, g, or t
  misc_feature (85)..(85): n is a, c, g, or t
agnggtcccctggaagcaaagccttgtcagcttgcctactngacaaagtagtaaaaagcactaatcagngttgagtcagatgtcnacagaaaaatacaatacctatgaggaatccagcaaaaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactcgtgtgtgtgtgtgtgtgtgtgtgtgtgtgtgtgtgtgcatacagacacacatatttctgaaatgtaaatattctctttttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaa

SEQ ID NO: 441571 - DNA, 4370 bp, Homo sapiens
tgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccggtccgcccctcacttgtggtggggcgcagctcctggtccctcagctgcgcgccgccccacgcggccgggctgcgggtctagggggtccgcatctccctggctttccaagggctaaggtcgtgattctagggcggctgggcgtccagggcctcggtgggggtggcgtgtctgccctttttatctccccgcaaggcccccagtcttctagggaagccagtcagtgaagcgcggaggtccgggcgcgccgagagagagtccagtctttgaggaccgagtagtcctgggccacctcccgcctctgctgtcagaagcagcagctgccgccgtggaatccaaaatttcgggagctgtgaccctttcctcatgtaaaacgagtagtcttggacgatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcatctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactcgtgtgtgtgtgtgtgtgtgtgtgtgtgtgtgtgtgtgcatacagacacacatatttctgaaatgtaaatattctctttttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaa

SEQ ID NO: 441572 - DNA, 3872 bp, Homo sapiens
tgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcatctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactcgtgtgtgtgtgtgtgtgtgtgtgtgtgtgtgtgtgtgcatacagacacacatatttctgaaatgtaaatattctctttttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaa

SEQ ID NO: 441573 - DNA, 747 bp, Homo sapiens
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaa

SEQ ID NO: 441574 - DNA, 499 bp, Homo sapiens
tgtgctgttctagaacaccacaacagcccaagaaggaagaaaacaaaaaaaactctgcattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaa

SEQ ID NO: 441575 - DNA, 693 bp, Homo sapiens
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacgaatatcaagtatagatttgactcaaacaattgtaatttttgaaataaactagcaaaaccagaa

SEQ ID NO: 441576 - DNA, 795 bp, Homo sapiens
ggtaagagcacatgcgcgctgcgcgacacacggtgcgatggataatcatggacctaatcctgctgtgacctaccgagatctcgggccatctcgactgatgcccggacttctctgccgctcctaagagcggccagaagggtgccgactcttctgccttatgtgctaccaccttcttctcaactatctttctcggaggcttctccacactctgtccgttcacgatggcgtacttgcagcatcagcctccacagcgccctggaccagccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaa

SEQ ID NO: 441577 - DNA, 1036 bp, Homo sapiens
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagtaacacgtggaggaacatacgttgggaatatcaactgacacgcactgtgctaggatctagaaataccatgtggactccaacacacatagaaataaggaagtggaattccaaaggaaggcaaagtgtaaagtcgtctttatggaaatgagtgatgaaggtgaatacctgaatgagatgtcaagaggaggaacacactggagagaagcagtaaagatttaggactgaaccttaaagacatacaggcttgagagaaagaaagcatgtaaagaagacagaaatggttagaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaa

SEQ ID NO: 441578 - DNA, 1050 bp, Homo sapiens
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaaaaaaaaaaaaaaaaaaaaaaaaaaatttggggggggcgggcagaaagagtttccaaagacacacccctgtggggggcgcgggggcccaggtaggtgtaaggtagaccgtcgggacaaaaggcgtggccccaagagagaaaccgtgggcaagagacacacggcgtcgggttttctccaccaaaaaaaaaagcgcgggggggaacccgagcgcgttcggaaaaatcccaagatgggggccaggaggccataccggggtgtcatcaaccgggggccaggcaggcagaataaatacgcgacagaggg

SEQ ID NO: 441579 - DNA, 2440 bp, Homo sapiens
cccaggctggagtccagtggcgcgatctcggctcactgcaacctctgcctcctgggttcctgccattcttctgcctcagcctcaaaagtagctgagattacaggtgcccaccaccatgcctagctaacttctgtatttttagttgagacggggtttcaccacgttggccgggctggtctcgaactcctgccctcaggtgatctgcccacctcggcctcccaaagtgctgggattacaggcttgagccatcgtgcccggccagatccacctttcttatacctcctagccataaatactgaagtcttattttgaatatggcaaaaatacatatcctttttaaaggtttctttctaaaaagcagaaacataaaaataaactgtaaggaaattatttccctttaaaacattaacatttgttttaaacaatcctcatctccccaattttttttttaattagctggagccagctgagttaaagacaacttatgattacaagtgactaggatgtacatctcttaaaaatatagacagtccatcatcaagattgtaaggacatcatatcaattccttatagttgttatattgtcattttagagtcaaataaattgtaaatatggataggacaatatacagacaccaagtgatatttcatctaagaagttaaggagattaaatgaaagctggaggaaatctttcaccagccccaaataaatgtgaagtgggaaatgtaaagggaaaaaaggggaggcaagaaaacctcttctcacatatttgggaaaagaaacttgtgtgggtaaggaatgggtaaaatagaacctggttaggaccagccattcacatttgatagtacagaaagcttaccaatactaccgttaaaactatttttaggagtaaaataagttacataggaacactgttgtgagatgcacacaactttccctttgaaaaattatctgctgttaactatattcattttctttcaaggtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaagcagctagaaatattcttggaggaaaaggacctggatatcaagtagggtaaaggtgggggtgtcttttttcactttaagcatcttgttttctaatcatgtgtgataattgggtgaaaaattcttagctcaaagtgttttaaaaacaggtaaagcaaagaaactagcaggaccactctcagttaagattaaaactaaagtccagtgttaagctaaaggagaaatagaaattaatggttctaattctgtttgggctgctaggaacaacagaaatttttcatggttctagaagctggaaagtcctgggtcaaggcccagcagatcctgttaggtgagggcccgcttcctggctcatagatggtgccttctcactgtgtggtggaaggggcaagtgagccctctgggttctcgtttttgaaatggagtctcgctctgttgcccaggctggagtacagcagcacgatctcggctcactgcaatctctgccccctgggttcaagtgattctcctgcctcagcctcccaagtagctgggactataggcatgtgccatcacacctagctaatttttgtagttttttgtagaaacagggttcaccatgttggccaggctggtctcgaactcgtgacctcaggtgatccgcctgccttggccccccaaagtgctgggattacaggtgtgagccaatgtgcccagcctgggttctcttttgtaagggcacttactccaatcttgagggttctgccctcgtgatctaataacttcccaaagacccccacctgctaatatcaccttgggggttgggattttaacatacaaatttaggggaaacacatggagaccacagcaatggccaatccttagcgaatcttaggtccttcccagatctaaaatgccaagctacacttgcatttcctttttttaagattatgaaacttcaaaatatatgaactacagcccatattgaaaaataaaatagattgagccatatgcctaaaaaagacctcaagaaaagtttgaggcaaagcatgttagtgttacaggaaatggtccaatagagggggaagaaaaaaagcatgctactagccccttttcttgtaccgagaataaaaccatgcagatctcaaacctccaagtctatagtattgaaaagaccaagttcacttctcagaagtctccaagttcagttgactgtggcactct

SEQ ID NO: 441580 - DNA, 748 bp, Homo sapiens
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccgacagcataatataatttgttaagtgggtctcggttcgctcatagggaggttaagagtatatgtgatttcagcaccagcttctcgtcaagaatcttgctacgccctaacggcatgtctcttttcaaacacgtccgcagttattagttgagtcccagtacagcacaaggtacaaaggggaaacccatggtaggtagtgttatcattgatagatccaacattgaatatcacgggttcattttaatctttccttggtaatgcttagaatgaactagcatatcctta

SEQ ID NO: 441581 - DNA, 533 bp, Homo sapiens
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaa

SEQ ID NO: 441582 - DNA, 958 bp, Homo sapiens
  misc_feature (4)..(4): n is a, c, g, or t
  misc_feature (29)..(29): n is a, c, g, or t
  misc_feature (47)..(47): n is a, c, g, or t
  misc_feature (60)..(60): n is a, c, g, or t
  misc_feature (65)..(65): n is a, c, g, or t
  misc_feature (67)..(67): n is a, c, g, or t
  misc_feature (72)..(73): n is a, c, g, or t
  misc_feature (80)..(80): n is a, c, g, or t
  misc_feature (82)..(83): n is a, c, g, or t
  misc_feature (94)..(94): n is a, c, g, or t
  misc_feature (98)..(100): n is a, c, g, or t
  misc_feature (102)..(102): n is a, c, g, or t
  misc_feature (114)..(117): n is a, c, g, or t
  misc_feature (119)..(119): n is a, c, g, or t
  misc_feature (122)..(122): n is a, c, g, or t
  misc_feature (126)..(127): n is a, c, g, or t
  misc_feature (130)..(130): n is a, c, g, or t
ttgngctcctaggggcggagaagggtgcnggttcttcgtcttttctntaattatttaaanaaatnancctanntaaacananntatcaacttanttannnanataattataaannnngnaanaatnnatnagatgaatataatgaataaggtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaaaaaaaaaaaaaaaaaaaaaaaaaaatttggggggggcgggcagaaagagtttccaaagacacacccctgtggggggcgcgggggcccaggtaggtgtaaggtagaccgtcgggacaaaaggcgtggccccaagagagaaaccgtgggcaagagacacacggcgtcgggttttctccaccaaaaaaaaaagcgcgggggggaacccgagcgcgttcggaaaaatcccaagatgggggccaggaggccataccggggtgtcatcaaccgggggccaggcaggcagaataaatacgcgacagaggg

SEQ ID NO: 441583 - DNA, 1948 bp, Homo sapiens
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaagcagctagaaatattcttggaggaaaaggacctggatatcaagtagggtaaaggtgggggtgtcttttttcactttaagcatcttgttttctaatcatgtgtgataattgggtgaaaaattcttagctcaaagtgttttaaaaacaggtaaagcaaagaaactagcaggaccactctcagttaagattaaaactaaagtccagtgttaagctaaaggagaaatagaaattaatggttctaattctgtttgggctgctaggaacaacagaaatttttcatggttctagaagctggaaagtcctgggtcaaggcccagcagatcctgttaggtgagggcccgcttcctggctcatagatggtgccttctcactgtgtggtggaaggggcaagtgagccctctgggttctcgtttttgaaatggagtctcgctctgttgcccaggctggagtacagcagcacgatctcggctcactgcaatctctgccccctgggttcaagtgattctcctgcctcagcctcccaagtagctgggactataggcatgtgccatcacacctagctaatttttgtagttttttgtagaaacagggttcaccatgttggccaggctggtctcgaactcgtgacctcaggtgatccgcctgccttggccccccaaagtgctgggattacaggtgtgagccaatgtgcccagcctgggttctcttttgtaagggcacttactccaatcttgagggttctgccctcgtgatctaataacttcccaaagacccccacctgctaatatcaccttgggggttgggattttaacatacaaatttaggggaaacacatggagaccacagcaatggccaatccttagcgaatcttaggtccttcccagatctaaaatgccaagctacacttgcatttcctttttttaagattatgaaacttcaaaatatatgaactacagcccatattgaaaaataaaatagattgagccatatgcctaaaaaagacctcaagaaaagtttgaggcaaagcatgttagtgttacaggaaatggtccaatagagggggaagaaaaaaagcatgctactagccccttttcttgtaccgagaataaaaccatgcagatctcaaacctccaagtctatagtattgaaaagaccaagttcacttctcagaagtctccaagttcagttgactgtggcactct

SEQ ID NO: 441584 - DNA, 1939 bp, Homo sapiens
  misc_feature (1263)..(1263): n is a, c, g, or t
  misc_feature (1288)..(1288): n is a, c, g, or t
  misc_feature (1292)..(1292): n is a, c, g, or t
  misc_feature (1325)..(1325): n is a, c, g, or t
  misc_feature (1344)..(1344): n is a, c, g, or t
  misc_feature (1364)..(1364): n is a, c, g, or t
  misc_feature (1367)..(1367): n is a, c, g, or t
  misc_feature (1369)..(1369): n is a, c, g, or t
  misc_feature (1381)..(1381): n is a, c, g, or t
  misc_feature (1397)..(1397): n is a, c, g, or t
  misc_feature (1411)..(1411): n is a, c, g, or t
  misc_feature (1422)..(1422): n is a, c, g, or t
  misc_feature (1439)..(1439): n is a, c, g, or t
  misc_feature (1458)..(1458): n is a, c, g, or t
  misc_feature (1472)..(1472): n is a, c, g, or t
  misc_feature (1484)..(1484): n is a, c, g, or t
  misc_feature (1487)..(1487): n is a, c, g, or t
  misc_feature (1489)..(1489): n is a, c, g, or t
  misc_feature (1504)..(1506): n is a, c, g, or t
  misc_feature (1508)..(1508): n is a, c, g, or t
  misc_feature (1548)..(1548): n is a, c, g, or t
  misc_feature (1550)..(1551): n is a, c, g, or t
  misc_feature (1554)..(1555): n is a, c, g, or t
  misc_feature (1562)..(1562): n is a, c, g, or t
  misc_feature (1565)..(1565): n is a, c, g, or t
  misc_feature (1567)..(1567): n is a, c, g, or t
  misc_feature (1577)..(1577): n is a, c, g, or t
  misc_feature (1586)..(1586): n is a, c, g, or t
  misc_feature (1592)..(1592): n is a, c, g, or t
  misc_feature (1594)..(1594): n is a, c, g, or t
  misc_feature (1599)..(1599): n is a, c, g, or t
  misc_feature (1603)..(1603): n is a, c, g, or t
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcagaatgacctaaagaaacccaacaatgaatatcaagtatagatttgactcaaacaattgtaatttttgaaataaactagcaaaaccagaagcagctagaaatattcttggaggaaaaggacctggatatcaagtagggtaaaggtgggggtgtcttttttcactttaagcatcttgttttctaatcatgtgtgataattgggtgaaaaattcttagctcaaagtgttttaaaaacaggtaaagcaaagaaactagcaggaccactctcagttaagattaaaactaaagtccagtgttaagctaaaggagaaatagaaattaatggttctaattctgtttgggctgctaggaacaacagaaatttttcatggttctagaagctggaaagtcctgggtcaaggcccagcagatcctgttaggtgagggcccgcttcctggctcatagatggtgccttctcactgtgtggtggaaggggcaagtgagccctctgggttctcgtttttgaaatggagtctcgctctgttgcccaggctggagtacagcagcacgatctcggctcactgcaatctctgccccctgggttcaactcagccccccccctcccncccgcccaccatacccctctccccncacncctccctaatttttctacttttttctacacacncccttcaccatcttccccnccctcctctcccactcctcnccncncctcatcccccncccttccccccccccncccctcccatcacncctctcacccnatctcccccccctcccnccccttttctcaccccacncaccccaatcttcncccctctccccnccncntctcatcacttcccnnncnccccccccccctcatatccccttcccccttcccattttcncnnccnnatttacnccncncacatccccnccaccccantccccnanccttncccnctcttccgtccttcccagatctaaaatgccaagctacacttgcatttcctttttttaagattatgaaacttcaaaatatatgaactacagcccatattgaaaaataaaatagattgagccatatgcctaaaaaagacctcaagaaaagtttgaggcaaagcatgttagtgttacaggaaatggtccaatagagggggaagaaaaaaagcatgctactagccccttttcttgtaccgagaataaaaccatgcagatctcaaacctccaagtctatagtattgaaaagaccaagttcacttctcagaagtctccaagttcagttgactgtggcactct

SEQ ID NO: 441585 - DNA, 684 bp, Homo sapiens
gcgcatgcgcgcttcgtcacaagggtgcgaggaaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagtgtcgatatgaacataacgtacatgtcacctgcaaaattaggagaagatatagtgattacagcacatgttctgaagcaaggaaaaacacttgcatttacctctgtggatctgaccaacaaggccacaggaaaattaatagcacaaggaagacacacaaaacacctgggaaactgagagaacagcctctcaaacactggaaattaagccttt

SEQ ID NO: 441586 - DNA, 3315 bp, Homo sapiens
gttttttttcatatcaaatttacctgtttattcattccatagcaagcaggatattcactatttaaaacaaatttaagcagatttctgttagatttctttaaatcactgaaaagtaacacaaaaatacatataggtagtaactaagtactgacaaagtattctacctatgcaatatcctattaaatgtctaaattaccatatgtaaatttaattgtattatttactcaatggggaaaatctggattacagaactgaggaaaattatgttttatgtaaattataaaaggccaaagtcaatcatgttgaataaaataattttgaaatataagccagtaatataccatatgagtatcccaagagaaaccctggatagaaagaaacttttaaagtcactctttttttttttattagtaatgttaatgtttgagctcagtgtttgagcatgctggttttacctatttatgctaattttaaaccaacaattgaagtgagaaaataatcatttatccttgaaagtatctttagcatggtcttcctaattaaaaataccacttaaaaaagtgaggcagcaaaagcatgaactggagtcagtggtctgtctgggttaaaattggccccacgatttactacctatgacttcaagcaagttgcttaacctcgcacttcatcccacttcattatctcatttgtgaaatagaggtaaataattaaccctgtactcacagggaataccgagattatgcatgtaaagtgcttacagtgcctagcacatagtaagtgcctaataaatgttagccataaatattattgtgggtatagaaaatcaaattccctagttgcaaaatgtatgcactaaatgctgaatatcaaagaagtcaaaattcaaccacacaagtcttaacagttatagagtctttgcatggacacagtttcgaagctaaaaaatgagaacctaatattacatgcaagttatgtgactcatcagtaaattcttcctagaaaaacaaactataccacttgtcagattcttccagcataagcctgagtccccttgcacctataattagattcttattttactatcttttgcgtatcttgtattaattttacttggttgataagatgttgaagaaaccatggaattatacacagcactatacattattactatagaatgtctggtccctcccatcataaatatggtttaatgaagttattgaaaaacttcacaatatcgagctgcaattcttttttctttttatacaaatacaagttaattagctctattaagttgcaattttatttttataaagctttgtaaagttatgaacatggaaaccctaagaatcacctaagctttttacataagtaaatttcaagttgacagtctgtccattttgaactatttataattaacaggacacttaacacagtaatatcttagacaaggaagagggcattaattctgcaggcaggtagcaatgaaaatgccaaacctgaacaatcagtcactatttccttatacagtttgagtaaaagaggtagactacagaaagaaaaaaaaaagtgaatataaaatgtatcttccccaaatacaactctacttcaataagtcttgaagattaccgatgacatcaacaaaaatgaatgaactcagggaatgagttctttctccccatcaaagaaaaaaacagcatgtgtaattttaaatttgaaaaaaaaaaagaatggcaatttgcaagccaaaagaaaaccagattcacattctactatttacatttgttctattcacaggtcaaaaataaaatatttcattagataatttaaaaaaaaaacacttttttaaaacaaatgtattttactccatcaatactgcaaggaagataactgaatttagaaatgctctctctctacagcaaagttaacttaacttttcggggcccaactggcctatcatttagatctttaatagcagccatagcttcattatagtttatcatagcaacaatggcttcccctgtaggtaagccttgctcattatactgtatcgaaactgaatcaggtatgattctgtaaccatggaaaaagtctaaaatttcattcacattagctttaaatggaagattcattatcttaataggagttactctacctgaaccacaatttatttttggatcaggcataaatctcccctcaggaaaacttcccatattatgctttccaaaatcaaacttgccaccttctgggcgaccaaaattcacaaaagggcggtgacttctaaaatcatcaggcgggctcctaaaatcctcaccaggaggtctaaaattgtcaggaagtctagggtcctcctccggagcttccctaaggtcttcctctgggagctgcctgaagtcctcatcagaagggcatctaaaatcttcctcctgggggctcctgaagtcctcatcaggagggtgcctaaagtcttcatcaggagggcccctgaagtcttcatctggtgggtgcctgaaatcttcctctcgggagcgcctgaaatgctcctgaggcggccgcctgaaatgctcctggggcggtctccggaagtgctccgggggcgggcgcctgaaatgctctgggggtggccgcctgaagtgctctgggggtggccgccggaagtgctctgggggaggccgcctaaaatgctctggaggtggtctccggaaatgctctgggggtggccgacggaaatgctcctgaggtggcctccggaaatgctcctggggtgactgcctgaagtcctcctcaggggaatgcctgaaatcctcctctgggggccgcctgaagtcatcctcgggtggtcgcctccattctccctgaagaggccgcctaaagtcctcctctgggggccgtctccagtcctcctcaggtggccgcctgaaatcttcctctgggagccaccttaagtcctcctcagggggttgcctgaagtcctcctcggggagctgcctgaagtcctccgtgggagaccgcctgaaatcctcctccagtggccgcctccagtcctcctcaaggggcctcctccagtcctcctccctagggtgcctgaagtcatcctccggagggcgcctgaaatcttcctcccaagggcgcctgaagtcctcctcagaaggccgcctgaagtcttcctccctaggtcgcctgaagtcctctggggagtgcctgaagtcctccggggggaacctaaagtcctctgaggagtgtcggaagtcttctggagggtgcctgtcaggctgccggaaatccctctggggatgcttgaagttatccagttgcctc

SEQ ID NO: 441587 - DNA, 3262 bp, Homo sapiens
gttttttttcatatcaaatttacctgtttattcattccatagcaagcaggatattcactatttaaaacaaatttaagcagatttctgttagatttctttaaatcactgaaaagtaacacaaaaatacatataggtagtaactaagtactgacaaagtattctacctatgcaatatcctattaaatgtctaaattaccatatgtaaatttaattgtattatttactcaatggggaaaatctggattacagaactgaggaaaattatgttttatgtaaattataaaaggccaaagtcaatcatgttgaataaaataattttgaaatataagccagtaatataccatatgagtatcccaagagaaaccctggatagaaagaaacttttaaagtcactctttttttttttattagtaatgttaatgtttgagctcagtgtttgagcatgctggttttacctatttatgctaattttaaaccaacaattgaagtgagaaaataatcatttatccttgaaagtatctttagcatggtcttcctaattaaaaataccacttaaaaaagtgaggcagcaaaagcatgaactggagtcagtggtctgtctgggttaaaattggccccacgatttactacctatgacttcaagcaagttgcttaacctcgcacttcatcccacttcattatctcatttgtgaaatagaggtaaataattaaccctgtactcacagggaataccgagattatgcatgtaaagtgcttacagtgcctagcacatagtaagtgcctaataaatgttagccataaatattattgtgggtatagaaaatcaaattccctagttgcaaaatgtatgcactaaatgctgaatatcaaagaagtcaaaattcaaccacacaagtcttaacagttatagagtctttgcatggacacagtttcgaagctaaaaaatgagaacctaatattacatgcaagttatgtgactcatcagtaaattcttcctagaaaaacaaactataccacttgtcagatttatcttttgcgtatcttgtattaattttacttggttgataagatgttgaagaaaccatggaattatacacagcactatacattattactatagaatgtctggtccctcccatcataaatatggtttaatgaagttattgaaaaacttcacaatatcgagctgcaattcttttttctttttatacaaatacaagttaattagctctattaagttgcaattttatttttataaagctttgtaaagttatgaacatggaaaccctaagaatcacctaagctttttacataagtaaatttcaagttgacagtctgtccattttgaactatttataattaacaggacacttaacacagtaatatcttagacaaggaagagggcattaattctgcaggcaggtagcaatgaaaatgccaaacctgaacaatcagtcactatttccttatacagtttgagtaaaagaggtagactacagaaagaaaaaaaaaagtgaatataaaatgtatcttccccaaatacaactctacttcaataagtcttgaagattaccgatgacatcaacaaaaatgaatgaactcagggaatgagttctttctccccatcaaagaaaaaaacagcatgtgtaattttaaatttgaaaaaaaaaaagaatggcaatttgcaagccaaaagaaaaccagattcacattctactatttacatttgttctattcacaggtcaaaaataaaatatttcattagataatttaaaaaaaaaacacttttttaaaacaaatgtattttactccatcaatactgcaaggaagataactgaatttagaaatgctctctctctacagcaaagttaacttaacttttcggggcccaactggcctatcatttagatctttaatagcagccatagcttcattatagtttatcatagcaacaatggcttcccctgtaggtaagccttgctcattatactgtatcgaaactgaatcaggtatgattctgtaaccatggaaaaagtctaaaatttcattcacattagctttaaatggaagattcattatcttaataggagttactctacctgaaccacaatttatttttggatcaggcataaatctcccctcaggaaaacttcccatattatgctttccaaaatcaaacttgccaccttctgggcgaccaaaattcacaaaagggcggtgacttctaaaatcatcaggcgggctcctaaaatcctcaccaggaggtctaaaattgtcaggaagtctagggtcctcctccggagcttccctaaggtcttcctctgggagctgcctgaagtcctcatcagaagggcatctaaaatcttcctcctgggggctcctgaagtcctcatcaggagggtgcctaaagtcttcatcaggagggcccctgaagtcttcatctggtgggtgcctgaaatcttcctctcgggagcgcctgaaatgctcctgaggcggccgcctgaaatgctcctggggcggtctccggaagtgctccgggggcgggcgcctgaaatgctctgggggtggccgcctgaagtgctctgggggtggccgccggaagtgctctgggggaggccgcctaaaatgctctggaggtggtctccggaaatgctctgggggtggccgacggaaatgctcctgaggtggcctccggaaatgctcctggggtgactgcctgaagtcctcctcaggggaatgcctgaaatcctcctctgggggccgcctgaagtcatcctcgggtggtcgcctccattctccctgaagaggccgcctaaagtcctcctctgggggccgtctccagtcctcctcaggtggccgcctgaaatcttcctctgggagccaccttaagtcctcctcagggggttgcctgaagtcctcctcggggagctgcctgaagtcctccgtgggagaccgcctgaaatcctcctccagtggccgcctccagtcctcctcaaggggcctcctccagtcctcctccctagggtgcctgaagtcatcctccggagggcgcctgaaatcttcctcccaagggcgcctgaagtcctcctcagaaggccgcctgaagtcttcctccctaggtcgcctgaagtcctctggggagtgcctgaagtcctccggggggaacctaaagtcctctgaggagtgtcggaagtcttctggagggtgcctgtcaggctgccggaaatccctctggggatgcttgaagttatccagttgcctc

SEQ ID NO: 441588 - DNA, 3204 bp, Homo sapiens
gttttttttcatatcaaatttacctgtttattcattccatagcaagcaggatattcactatttaaaacaaatttaagcagatttctgttagatttctttaaatcactgaaaagtaacacaaaaatacatataggtagtaactaagtactgacaaagtattctacctatgcaatatcctattaaatgtctaaattaccatatgtaaatttaattgtattatttactcaatggggaaaatctggattacagaactgaggaaaattatgttttatgtaaattataaaaggccaaagtcaatcatgttgaataaaataattttgaaatataagccagtaatataccatatgagtatcccaagagaaaccctggatagaaagaaacttttaaagtcactctttttttttttattagtaatgttaatgtttgagctcagtgtttgagcatgctggttttacctatttatgctaattttaaaccaacaattgaagtgagaaaataatcatttatccttgaaagtatctttagcatggtcttcctaattaaaaataccacttaaaaaagtgaggcagcaaaagcatgaactggagtcagtggtctgtctgggttaaaattggccccacgatttactacctatgacttcaagcaagttgcttaacctcgcacttcatcccacttcattatctcatttgtgaaatagaggtaaataattaaccctgtactcacagggaataccgagattatgcatgtaaagtgcttacagtgcctagcacatagtaagtgcctaataaatgttagccataaatattattgtgggtatagaaaatcaaattccctagttgcaaaatgtatgcactaaatgctgaatatcaaagaagtcaaaattcaaccacacaagtcttaacagttatagagtctttgcatggacacagtttcgaagctaaaaaatgagaacctaatattacatgcaagttatgtgactcatcagtaaattcttcctagaaaaacaaactataccacttgtcagattcttccagcataagcctgagtccccttgcacctataattagattcttattttactatcttttgcgtatcttgtattaattttacttggttgataagatgttgaagaaaccatggaattatacacagcactatacattattactatagaatgtctggtccctcccatcataaatatggtttaatgaagttattgaaaaacttcacaatatcgagctgcaattcttttttctttttatacaaatacaagttaattagctctattaagttgcaattttatttttataaagctttgtaaagttatgaacatggaaaccctaagaatcacctaagctttttacataagtaaatttcaagttgacagtctgtccattttgaactatttataattaacaggacacttaacacagtaatatcttagacaaggaagagggcattaattctgcaggcaggtagcaatgaaaatgccaaacctgaacaatcagtcactatttccttatacagtttgagtaaaagaggtagactacagaaagaaaaaaaaaagtgaatataaaatgtatcttccccaaatacaactctacttcaataagtcttgaagattaccgatgacatcaacaaaaatgaatgaactcagggaatgagttctttctccccatcaaagaaaaaaacagcatgtgtaattttaaatttgaaaaaaaaaaagaatggcaatttgcaagccaaaagaaaaccagattcacattctactatttacatttgttctattcacaggtcaaaaataaaatatttcattagataatttaaaaaaaaaacacttttttaaaacaaatgtattttactccatcaatactgcaaggaagataactgaatttagaaatgctctctctctacagcaaagttaacttaacttttcggggcccaactggcctatcatttagatctttaatagcagccatagcttcattatagtttatcatagcaacaatggcttcccctgtaggtaagccttgctcattatactgtatcgaaactgaatcaggtatgattctgtaaccatggaaaaagtctaaaatttcattcacattagctttaaatggaagattcattatcttaataggagttactctacctgaaccacaatttatttttggatcaggcataaatctcccctcaggaaaacttcccatattatgctttccaaaatcaaacttgccaccttctgggcgaccaaaattcacaaaagggcggtgacttctaaaatcatcagaagggcatctaaaatcttcctcctgggggctcctgaagtcctcatcaggagggtgcctaaagtcttcatcaggagggcccctgaagtcttcatctggtgggtgcctgaaatcttcctctcgggagcgcctgaaatgctcctgaggcggccgcctgaaatgctcctggggcggtctccggaagtgctccgggggcgggcgcctgaaatgctctgggggtggccgcctgaagtgctctgggggtggccgccggaagtgctctgggggaggccgcctaaaatgctctggaggtggtctccggaaatgctctgggggtggccgacggaaatgctcctgaggtggcctccggaaatgctcctggggtgactgcctgaagtcctcctcaggggaatgcctgaaatcctcctctgggggccgcctgaagtcatcctcgggtggtcgcctccattctccctgaagaggccgcctaaagtcctcctctgggggccgtctccagtcctcctcaggtggccgcctgaaatcttcctctgggagccaccttaagtcctcctcagggggttgcctgaagtcctcctcggggagctgcctgaagtcctccgtgggagaccgcctgaaatcctcctccagtggccgcctccagtcctcctcaaggggcctcctccagtcctcctccctagggtgcctgaagtcatcctccggagggcgcctgaaatcttcctcccaagggcgcctgaagtcctcctcagaaggccgcctgaagtcttcctccctaggtcgcctgaagtcctctggggagtgcctgaagtcctccggggggaacctaaagtcctctgaggagtgtcggaagtcttctggagggtgcctgtcaggctgccggaaatccctctggggatgcttgaagttatccagttgcctc

SEQ ID NO: 441589 - DNA, 4356 bp, Homo sapiens
agcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccaggagagcagatgtgaaggacctgcaccaggatggtggttagcaacagtggcccgtgccaaagcacttaccaaagtgatgatgactaagaccctgtcattaattccatgtgtcaatactgccctgtagtacacagagcagacaagaaagaagagcccttgaaaacaagggaatgatttttgagtcgttatcaagctaagtggcaagcgggaagctgaaactcgtatagttgaacattcttggaggcttatctcttccctggccagatgcctgatcagatgagaagcccgccatgatactgtcacagtgcctagaatgggctctttatccagtagacaccactgtactttttgatacgagggcagtcttaacttgtgttaaggcctgtgtgtagcattgaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttagtgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatgggcaaagaaagaggctgctagattgaagggcaggcatactgaaagaagaaaaaggccaacttgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagt

SEQ ID NO: 441590 - DNA, 3837 bp, Homo sapiens
agcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaaagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttagtgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatgggcaaagaaagaggctgctagattgaagggcaggcatactgaaagaagaaaaaggccaacttgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagt

SEQ ID NO: 441591 - DNA, 4449 bp, Homo sapiens
agcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaaggcacccgaaatgtgagatttgatggagaacataaagctttgacattaaactagttatagcgttgacagaaaacagaagatcatgcttgccagtaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccaggagagcagatgtgaaggacctgcaccaggatggtggttagcaacagtggcccgtgccaaagcacttaccaaagtgatgatgactaagaccctgtcattaattccatgtgtcaatactgccctgtagtacacagagcagacaagaaagaagagcccttgaaaacaagggaatgatttttgagtcgttatcaagctaagtggcaagcgggaagctgaaactcgtatagttgaacattcttggaggcttatctcttccctggccagatgcctgatcagatgagaagcccgccatgatactgtcacagtgcctagaatgggctctttatccagtagacaccactgtactttttgatacgagggcagtcttaacttgtgttaaggcctgtgtgtagcattgaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttagtgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatgggcaaagaaagaggctgctagattgaagggcaggcatactgaaagaagaaaaaggccaacttgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagt

SEQ ID NO: 441592 - DNA, 2524 bp, Homo sapiens
ccttatcgtttagtaagatcaaatttctaaatgatgtttcgttccagttgaacattcttggaggcttatctcttccctggccagatgcctgatcagatgagaagcccgccatgatactgtcacagtgcctagaatgggctctttatccagtagacaccactgtactttttgatacgagggcagtcttaacttgtgttaaggcctgtgtgtagcattgaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttagtgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatgggcaaagaaagaggctgctagattgaagggcaggcatactgaaagaagaaaaaggccaacttgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagt

SEQ ID NO: 441593 - DNA, 1082 bp, Homo sapiens
agcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagaggtaaggtagagaaggctatttttgtctacctggaatttaattggtctgggacatccctagagtttcctgcaagagaagaatacaagttgggaaatggaaaaagttcccacttctcccattaagcaattgtattacccaggatatacttcttaaccattgtaagtcttattctttccatttgtgtgataacacctatcagaataggtgtaaaaatggactactattttgtaagatgccaaatatagttttctgagttgca

SEQ ID NO: 441594 - DNA, 3957 bp, Homo sapiens
agcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttagtgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatgggcaaagaaagaggctgctagattgaagggcaggcatactgaaagaagaaaaaggccaacttgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagt

SEQ ID NO: 441595 - DNA, 4100 bp, Homo sapiens
agcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccaggggaatccacatattctagaagctgccaacaaataaatatacaaacgtcaagtctgaaataccccagcttccacctgatttaaactatgcctcaaagaagatgcctacttatccggaagtacccagcagatgcccaactgaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttagtgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatgggcaaagaaagaggctgctagattgaagggcaggcatactgaaagaagaaaaaggccaacttgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagt

SEQ ID NO: 441596 - DNA, 1667 bp, Homo sapiens
agcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaagtatagtatcaaatttcttttcacctaactatggctgtgcctttgagttggttatttcctttgtctttcattttccaagtgtttcttttctcttgtggatttggaaactttccatttaatggtgtttttagagg

SEQ ID NO: 441597 - DNA, 1389 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441598 - DNA, 1404 bp, Homo sapiens
agcactcgttgtagatgaagccggtgtagatggagaacaggcccataagcaggagcaggtagcggcccctgaagaaagtctgccagatctcgttgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441599 - DNA, 1885 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactcaaaaaaaaaaaaaaaaaaaaaaaaaaaaaaaacaaaaaaaaaaaaaaaaaatacaacaaaaagagagcgaaacccaaacaataacactcaaaaagaccacgacacaacggcgcccaaaacacagcgcaccaccaaaaaacctcacacaccacgcgcacaccaataacacaccccacaccgcgcccacaccggcaacctaaccacctcgcaacacgaacccccacacaagcggagaaaaccacgcgcacaccatccagagaaaagaccacaagcctcacacgccaccaacacaacaccaccacaccacccccgcacccacagcgagccacacagcgagcacacacaaacaactgcgcaccacgaccacaaccacacgaaccaagctcacaccaggagaccccgcaagaccaccccacagacagaccagccaacacgaacaaaccccacccaaccccaccccaccgaaacacccacaccccaaagcgcgaacgcaggcg

SEQ ID NO: 441600 - DNA, 871 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgtaatacttcctaaatgtacatatcttcccccaccgtctgtttcacctggttcgttcatttgtttgtgg

SEQ ID NO: 441601 - DNA, 1338 bp, Homo sapiens
tcaacgttttcagccggagcccttttccatggacttaacaaatggcattggggcgcctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441602 - DNA, 1437 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatcccacagttgaaaaggtcaaaaagattaaaagagtcaaaattgcattaaagcttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441603 - DNA, 1320 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcaccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441604 - DNA, 1227 bp, Homo sapiens
aagcagtggtatcaacgcagagtgcccattacggccggggtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441605 - DNA, 1432 bp, Homo sapiens
ggcgttcttcatcacccagtcagggggtcgacggtccgtgggctatatctgacataacacatgtgctggttacgctgttgcctccagcgggcacgtcggctcgtgcaatactgtacttacgtgcacttgtggtacattatactaagtatatatgaatgacgcgtgagagacctgagttacgatgaagtcctaatatacacaatggtagataactcggcatggatctcctccaccttggtatcttcactcaggaagatagcacgttcatacacgacgacgtcttcgtatcatgtagtctatagtgctccttgtggtggagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441606 - DNA, 1046 bp, Homo sapiens
gacagccattaggtgacagccatttaggtacctaaatggctgcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441607 - DNA, 1248 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggtttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441608 - DNA, 1381 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttatcctcccacacactgttcccacactctccgcctgctggaaagactgcccccactatgcttactacctcacgcactcacgcatcccaaactggctatcacgtactaacaccttactactaacaactgacttaccatcatggaatgatagacaggctccgaagccttggcacctctcctcaccgcgaacacgcccataactcctcctgacactgactgccactcacacttacctggtctgtacctcagctaccactggcgcaacgcctcccacgctccactacgcgaaccctcgctacggcgctcactaaaccgcgctcacccactctggacaaccacgccactcccaacttcactaaacactcaagccccgctcagaactacttcagcgactggcccccccggcactcgccagcctggaaaccaccgggccactaatccctgaacccaaggccgcccgcacccagccccccaccgccgacgctcacccccaatcaaaaacaagagaacaacaagcagtcgaaacctgaacctccgacccttcactgcgcgacccacccccccactctcacccccagacacggagcgaagacacaacccccgcagcggagacaaacactaccacgacaccacactcacacccacggtacacactgaccaccactccccccagcgcgcactacccggcaccccatcaccacacacacataaactccccgccaacactgacgacccccatccacgacagc

SEQ ID NO: 441609 - DNA, 280 bp, Homo sapiens
ggaggaggagcatgcacagataaataaaaatggtccttctccctgagagtgtagaggggcagacagacctgtgtgtaaataccacactccagggtgagaaaagccatatcgatggcattatagagtcccatgctgtgtggagatgtgggcaattacttctgcccaaaggagttaggaaagcctgcagaaagaagttgacctaggaaggtttgttttttttttaggataaagaggaatttggataaacagttgaaattatttttctactcagaagattatt

SEQ ID NO: 441610 - DNA, 721 bp, Homo sapiens
ggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactcactttcagtgcattgtttgagattaaaaatagtatttcttaaacttgcttaatccatgataaagacatgttgctgtcatttttaaaaagtgacgtactacattatgggttttctgaaaaataccatgcctagatctaaaaaggaaaatttttaaatgccgagcacattaacctcttttgtcatt

SEQ ID NO: 441611 - DNA, 602 bp, Homo sapiens
ggcagatatctgagctcaagggttgagaacagcccagcaacataggtaccccatctctacaaaaatgcaaaaatagccaggtctggtgtgcaacacctgtaatcccagctactctgtatgggggatctcgagatcccccattacagcttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggggatctcgagatcccccatacagagtactctggactcatagaacttacacctgaagttatagtgaacttggcttcccctgctgtcagctctttgaaagtaaggctcatttttaaaattgtatccccaggacctagcatagctcctaactcaaaataggcactcactcatacttgtgtactctgtatggggatctcggta

SEQ ID NO: 441612 - DNA, 976 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatcaaccagtgaaatcgggccgagctcgatt

SEQ ID NO: 441613 - DNA, 1505 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacgataaagaggaatttggataaacagttgaaattatttttctactcagaagattatttcgagtagagataagttgaaataacttgagcagaggcattgacgaaattgaaaattgaagattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441614 - DNA, 1276 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatcccgtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441615 - DNA, 1245 bp, Homo sapiens
acccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggagcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactca

SEQ ID NO: 441616 - DNA, 823 bp, Homo sapiens
tggaagtcgtgcggaggtcagaaggcggaaccgctgctgggagacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgctctctgggtccttttcccccccggggcctctggggcccccgtcccccg

SEQ ID NO: 441617 - DNA, 1576 bp, Homo sapiens
tctggatactcggcccctcccgggaatgttttaccgcggcaagtaatcaggttcgcacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 441618 - DNA, 1551 bp, Homo sapiens
acccaaacagctagtagggccgcgtttaaatcgggcagaggctcctttcgccatggttgcgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 441619 - DNA, 1116 bp, Homo sapiens
  misc_feature (997)..(997): n is a, c, g, or t
  misc_feature (1005)..(1005): n is a, c, g, or t
  misc_feature (1015)..(1015): n is a, c, g, or t
  misc_feature (1022)..(1022): n is a, c, g, or t
  misc_feature (1084)..(1084): n is a, c, g, or t
tggaagtcgtgcggaggtcagaaggcggaaccgctgctgggagacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagatcaggattttagatgagctnacacatgnctatgctagnaatccanctgacccagctctgggcagcacgccgacacactgatgctatctgactctcatggatccccgnggctattgattcatggtacagtcttctcgatg

SEQ ID NO: 441620 - DNA, 1788 bp, Homo sapiens
tggaagtcgtgcggaggtcagaaggcggaaccgctgctgggagacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagcccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgagcctctgaccactactggtttaacaacgggggtctgattccatccaccgagacacccacgtcccccggttggacacagcttttgacgtcctacggacccccattctcgagaccccgtcgtagcgtcacatactagttctatgtaggctcatctctacgctcccttgtgtaccattttgccctccagtcactctctagtcgtactttccctgtgggcaagcgcctcgagacgaaatgggcttgctagggcctccccattgggagggccataaaggatacccaaatggtcgctcatttatcagggcatcctccggttctccaagtctctgcccgtgtgtgtgacaactgagtacatgcatttctgtccctacaaggaaaagtgatactaatgcgatagcttacatatccgtgacgagggccctgagggtaagttttgagggcacaggattcgcgcacgagaaaaaactagcaagctttagcatttccctattgtgtgtagagccaacaacggccaaacctctagaccatacatcgtacgagttggccaccaccttacgttacgctgtaccataagcttagtcccacgcagacgaagtcccaacacgtctctacgagtgacccattcttcccaatgtgatgatcccgg

SEQ ID NO: 441621 - DNA, 997 bp, Homo sapiens
atggtagtggtgaagaagaaagttgttgggtttctttaggagggtgaagttggttgacttttctaacattgcttttgattttagagcactgggaggagggggaaagagctcaccctgcctggagaggccagatcaggacaggctctttaaagacattttctcctcactaccattaactcttcctttttccatttcctctataggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 441622 - DNA, 1563 bp, Homo sapiens
tggaagtcgtgcggaggtcagaaggcggaaccgctgctgggagacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 441623 - DNA, 1557 bp, Homo sapiens
  misc_feature (25)..(26): n is a, c, g, or t
  misc_feature (34)..(34): n is a, c, g, or t
  misc_feature (68)..(68): n is a, c, g, or t
  misc_feature (73)..(73): n is a, c, g, or t
  misc_feature (78)..(78): n is a, c, g, or t
  misc_feature (89)..(89): n is a, c, g, or t
  misc_feature (91)..(91): n is a, c, g, or t
agaactatttacggaggcgatcacnngtttgtantttcatcacgaggcttgcgtatggttgtacgttncctgntctcngggcgtcatcngnatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 441624 - DNA, 1646 bp, Homo sapiens
aaaaaaatggagcatgtgtattatgtggccaatgtcttcagtctaacttggttatgagactaaaaccattcctcactgctctaacatgctgaagaaatcatctgagggggagggagatggatgctcagttgtcacatcaatggatgctgctagaatggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 441625 - DNA, 1219 bp, Homo sapiens
tctggatactcggcccctcccgggaatgttttaccgcggcaagtaatcaggttcgcacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcactgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 441626 - DNA, 422 bp, Homo sapiens
gacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaacccttggtggtatcctgattgtcatcaggcgcttccatgcgcgggcggtaggcgggacagccgggatttcccggagaagagtttccagggcatttgcgggaggactcaatggtttggaagcaaagactttgggggtgggggcgacggggagtgcgatgggggccaatgaggatgtggggttgtgggttcagcatcccactgtcctttgacctgaacatcctaaccagccctcctagtcaggaggttattaacgaattaactaaaaagtt

SEQ ID NO: 441627 - DNA, 2981 bp, Homo sapiens
agcggagtatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgcgggaggacggagaggcgtccgagccccgggccctggggcaggagcacgacatcaccctcttcgtcaaggctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatactctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatggaaccaaaaaaaa

SEQ ID NO: 441628 - DNA, 2030 bp, Homo sapiens
  misc_feature (1372)..(1372): n is a, c, g, or t
  misc_feature (1377)..(1377): n is a, c, g, or t
  misc_feature (1410)..(1410): n is a, c, g, or t
  misc_feature (1415)..(1416): n is a, c, g, or t
  misc_feature (1423)..(1423): n is a, c, g, or t
atccctacaaataaagttcaggaaggactctgaattctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggacgccctggatatcttcctcctgccagtcacaaaccctgatggatacgtgttctctcaaaccaaaaatcgtatgtggcggaagacccggtccaaggtatctggaagcctctgtgttggtgtggatcctaaccggaactgggatgcaggttttggaggacctggagccagcagcaacccttgctctgattcataccacggacccagtgccaactctgaagttgaagtgaaatccatagtggacttcatcaagagtcatggaaaagtcaaggccttcattaccctccacagctattcccagctgctgatgttcccctatgggtacaaatgtaccaagttagatgactttgatgagctgagtgaagtggcccaaaaggctgcccaatctctgagaagcctgcatggcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatcatggagcatgtgcgagaccacccctattagggccctggggaagaaacaagagccattaaaatctctttggtttgaagcaaaaaaaanaaaanaaaaaaaaaaaaaaaaaaaaaaaaaaaaaaaanaaaannaaaaaanaaaaaaaaaaaaaaaaaaaaaaccgccgggggcggggcgcccgcgccgagccaagaccaaaacaaccaaaacaagaggggcggggcgggccaaaagagaagagaagaacaacccgagaaaaaacaagacaaccaagaaaccagcagcggagaaaaacaacagagagaggaccaccacacacaaaaaacccgcgcacgaaaaaaacacaaggacgagaagccaccagagcggactaggacgcggcaccatcggcgtccacaacaaacggaggacatgaagagagaacaaaaaaaaaaaccccacagtggtggtaagaaccaaagggcgaggcacagacgaggggaggaaggcacagagacacagaagggagcgaccaagaagaaggggcaaggcaagacgggaggagacgaacagagacacagcacgggagaagagcgaacgccgcaccagacacgacagcgaagacaaagacgcgccagacgacgagaggatacacaggaaacacgagagacagcagcactgcgaccagcgacgcacacgcacgcacgggagccagagagaaaagacaagcagcgagcgacgagacgatgacgagaccgagagcacg

SEQ ID NO: 441629 - DNA, 1291 bp, Homo sapiens
atccctacaaataaagttcaggaaggactctgaattctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggacgccctggatatcttcctcctgccagtcacaaaccctgatggatacgtgttctctcaaaccaaaaatcgtatgtggcggaagacccggtccaaggtatctggaagcctctgtgttggtgtggatcctaaccggaactgggatgcaggttttggaggacctggagccagcagcaacccttgctctgattcataccacggacccagtgccaactctgaagttgaagtgaaatccatagtggacttcatcaagagtcatggaaaagtcaaggccttcattaccctccacagctattcccagctgctgatgttcccctatgggtacaaatgcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatcatggagcatgtgcgagaccacccctattagggccctggggaagaaacaagagccattaaaatctctttggtttgaagcaaa

SEQ ID NO: 441630 - DNA, 953 bp, Homo sapiens
ctatttattcacttgaaacatttcagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggacgccctggatatcttcctcctgccagtcacaaaccctgatggatacgtgttctctcaaaccaaaaatcgtatgtggcggaagacccggtccaaggtatctggaagcctctgtgttggtgtggatcctaaccggaactgggatgcaggttttggaggacctggagccagcagcaacccttgctctgattcataccacggacccagtgccaactctgaagttgaagtgaaatccatagtggacttcatcaagagtcatggaaaagtcaaggccttcattaccctccacagctattcccagctgctgatgttcccctatgggtacaaatgtaccaagttagatgactttgatgagctgagtgaagtggcccaaaaggctgcccaatctctgagaagcctgcatggcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatcatggagcatgtgcgagaccacccctattagggccctggggaagaaacaagagccattaaaatctctttggtttgaagcaaa

SEQ ID NO: 441631 - DNA, 829 bp, Homo sapiens
atccctacaaataaagttcaggaaggactctgaattctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggacgccctggatatcttcctcctgccagtcacaaaccctgatggatacgtgttctctcaaaccaaacctggattttgttcccttcttcaacaaggacctaaggagatgtgtaggaacttcaaaagcaaaataaaaatactcatt

SEQ ID NO: 441632 - DNA, 1366 bp, Homo sapiens
atccctacaaataaagttcaggaaggactctgaattctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggacgccctggatatcttcctcctgccagtcacaaaccctgatggatacgtgttctctcaaaccaaaaatcgtatgtggcggaagacccggtccaaggtatctggaagcctctgtgttggtgtggatcctaaccggaactgggatgcaggttttggaggacctggagccagcagcaacccttgctctgattcataccacggacccagtgccaactctgaagttgaagtgaaatccatagtggacttcatcaagagtcatggaaaagtcaaggccttcattaccctccacagctattcccagctgctgatgttcccctatgggtacaaatgtaccaagttagatgactttgatgagctgagtgaagtggcccaaaaggctgcccaatctctgagaagcctgcatggcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatcatggagcatgtgcgagaccacccctattagggccctggggaagaaacaagagccattaaaatctctttggtttgaagcaaa

SEQ ID NO: 441633 - DNA, 1769 bp, Homo sapiens
  misc_feature (1372)..(1372): n is a, c, g, or t
  misc_feature (1377)..(1377): n is a, c, g, or t
  misc_feature (1410)..(1410): n is a, c, g, or t
  misc_feature (1415)..(1416): n is a, c, g, or t
  misc_feature (1423)..(1423): n is a, c, g, or t
atccctacaaataaagttcaggaaggactctgaattctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggacgccctggatatcttcctcctgccagtcacaaaccctgatggatacgtgttctctcaaaccaaaaatcgtatgtggcggaagacccggtccaaggtatctggaagcctctgtgttggtgtggatcctaaccggaactgggatgcaggttttggaggacctggagccagcagcaacccttgctctgattcataccacggacccagtgccaactctgaagttgaagtgaaatccatagtggacttcatcaagagtcatggaaaagtcaaggccttcattaccctccacagctattcccagctgctgatgttcccctatgggtacaaatgtaccaagttagatgactttgatgagctgagtgaagtggcccaaaaggctgcccaatctctgagaagcctgcatggcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatcatggagcatgtgcgagaccacccctattagggccctggggaagaaacaagagccattaaaatctctttggtttgaagcaaaaaaaanaaaanaaaaaaaaaaaaaaaaaaaaaaaaaaaaaaaanaaaannaaaaaanaaaaaaaaaaaaaagagggggggcggcgcccaaaaatctcccccgcggggggcccccaatgcccccccccctttttttgtaaaaggggggcccccatagagggggagcgtattaaaaacacacgaccgaggagcagcgcggcgcccgtctctaaccaacagccgtgcgtcgaggaggcgaacaacacccgccccgcgcgcggaaatctgttgaaagaagcacgacacacctcgcagccggggggggcacacccaagctggcggcgcaacacacaacccccagacgagattttaaccccgccccgcgggggcgaaatttaaacatttccgacgctcctccagggcgc

SEQ ID NO: 441634 - DNA, 1141 bp, Homo sapiens
atccctacaaataaagttcaggaaggactctgaattctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggacgccctggatatcttcctcctgccagtcacaaaccctgatggatacgtgttctctcaaaccaaacacggacccagtgccaactctgaagttgaagtgaaatccatagtggacttcatcaagagtcatggaaaagtcaaggccttcattaccctccacagctattcccagctgctgatgttcccctatgggtacaaatgtaccaagttagatgactttgatgagctgagtgaagtggcccaaaaggctgcccaatctctgagaagcctgcatggcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatcatggagcatgtgcgagaccacccctattagggccctggggaagaaacaagagccattaaaatctctttggtttgaagcaaa

SEQ ID NO: 441635 - DNA, 619 bp, Homo sapiens
aattgaaaagcatcctgtacatgaaaaaagttattgcaaatgactcactttttgtgtggttccttctctccctttttccctcctatcgtcactttagaagtctggccttcattttcgacacacagataataccgtccagtggttaagagcgatggagtctattggtctacccaaggtaagccttcacgcactggaatctgaactagaaaggcaaaggggtagtacacaaacatctctttatgagcaatgactttggagactgggttatgttaatgtagaaatgagaaatgtgaggactaaaaaacatggaaagacctatccaaagtaacatatggcaagaactcagaatgagggatgtgcccagattgagagcagccaggtaaaattgtgcacaaaataaaggcagaacaagctatagctggtagataggtgagctatctaaaatagccaactccctttcttgtgttgctatttgtacataaagattctaagtctcagccacttttggtggctcatgcctataatcccagcactttgggaggctaaggtgagagaatcacttgaggccaggagtttgagaccagcctgggcaacatggcaagaccctgtctctattaaa

SEQ ID NO: 441636 - DNA, 563 bp, Homo sapiens
gagatcaggccactgcactccagcctgggtgacagagcaagactatgtctaaaaaaaaaagtctgaagaaattgcatttctgctactttgtgccccttttaaaacgcaatttttccttaaactaaatgtgtggttattctaaaataacttcttgcctttccatccagagcaaaattaatgttaacaagtctcttaaagtgaaatatgtacactttccagttctgaagtaaaaagggatgggaaccctgtggtgttgagagtaaaataaggtgcctgagataagctacaagtcaagttacaaatagcgacttactactgcttgatattcttcttgtcccaaactggcaatatcataaagcaaacttctgcttaaatatgataccccttacttggttgttttaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaa

SEQ ID NO: 441637 - DNA, 2279 bp, Homo sapiens
aggtccactgttgactgaaacattatgttgtttgtggttatatatgttcatgacactttggtctagctaagttcatttggaatctaagataagtttttatcgtttttattataaattagtggttcttcgtctgtaaaattttaagcccgcccatttataacattttgtaaggcttctttatcattctgaaatgaaatctatatgataaaatgtactgatgtatatacctcagaataagactagggcctttatatgaatacaaaagagatatttaaagagtaattaataataaaagcacacattttattgagaaaatgtatatgcctgatgacactgggaagacatgatacagttaccagaggtgtagacctcttcacagaacagctaccagattatgagggcttcagtggcaaatgaggcaggaactcattttccaaaatggagaacaactatttgtaaagttcaacattagccaagtgtagtctccacccaatttacatagcagttgcaattctagaaaatcctagcttttgtgtggggaaaatgtattatgcatctacataaaacaattagattctaggctcagataattacaaacagaatcttgacccacgtaaatgaccagtaagacattcaaaagttctgtcatgcaaggtgagggcaattatttacacaagaccatcccacaaattgccagatcacagagcacctctcatccccaatccctgctcactagaaaccaagagtgcccttcaattgttaagatattaaaaaacacccctacgtatttccaaaatgtgactccctacaaagacacactgcccccgttatgcccccattgataacttctaaataaattacggtgtggtttcacatctgtgtgaaacctgccaacatcagggctcaaaaaaaaaaaagtataaaaagtgtcatttttacccaagaacagatgcctaagaccactctccctgtccctgttcccttcctatgtgccacatcagttttcagaaaactgataggtcaaagagggaaactgatcttctggaagctctgagaaggctacagtggctcataggtggagcgccagcggccagcaaccaagcgaacgttctggacaacggggagatgagcagccacaggaggctgccagttacatgggcatgtgaatgccccaggctggtcctccagacctcataaagacaccagggcaattgtggaggagaaaataagaaaaacagcattttataaacagaaataatcatctcttctaaatattcaggaataaaactacagtttaaatgttctacatttaactctacttttattattttatccagaaaaacaacagtactttttaaaaaacaatgttatttgtattgtttgacatccatgagaacttttaaagtgtaatatattccagaaggattttcagagaatgctttttatagccttaaactgctgtttcacgctatccccataaaatcataaacaggaaatgtcttgccttttaaaataaaggcttagttgcaaatcagtacatagtttaaataatatgtatcttttggaaacacaatcatggcaagttatcagatttttatgaatgcttgaggttttgtgggggttttttaaagccacttatcactaatagataacattgtgaagtttttcaacatatttgcaaacaccagatatgtatccagcattttttagcggttaaattaatgattattaaatatgtagctgttagccttgtcattgacagaatattagtagtgatacaagaacagagcaattgaagctttatttatagtagtgaaaaagtgggaaacgacctgaagcccaaagcaatatgcagagggcgatagaattagtttaatatggatgttgtatagccactaaaaatgatggtttttagactattttaaagcaggaggaaaggtttgcgatatagtagaggagaaaatagtgcctaaggtagtatgatttcttttattatcaaaaaataataatccagaagaagaaagaagttaagtgatttttctttgggtgatagttaagtttatcttctccccctcctccccacacctttttatttttaacaatgagtgtgtgtttagtgaggaaaagagagattgtaaagggaaatggctttgttcttatagaacaatgctagctcttgctagtaaccttaacattttttatagttcttttaaatcagcattcctcctaaaatcctcaaaatctgtaggtcagtgaagtggctaacattggttttaggc

SEQ ID NO: 441638 - DNA, 507 bp, Homo sapiens
  misc_feature (453)..(453): n is a, c, g, or t
  misc_feature (467)..(467): n is a, c, g, or t
aggtccactgttgactgaaacattatgttgtttgtggttatatatgttcatgacactttggtctagctaagttcatttggaatctaagataagtttttatcgtttttattataaattagtggttcttcgtctgtaaaattttaagcccgcccatttataacattttgtaaggcttctttatcattctgaaatgaaatctatatgataaaatgtactgatgtatatacctcagaataagactagggcctttatatgaatacaaaagagatatttaaagagtaattaataataaaagcacacattttattgagaaaatgtatatgcctgatgacactgggaagacatgatacagttaccagaggtgtagacctcttcacagaacagctaccagattatgagggcttcagtggaccaaattgagggccagggaacctccatttttcccaatggggnggaaccaacctaantttggtaggtttccaaccattaagccccagtggtgttcct

SEQ ID NO: 441639 - DNA, 4270 bp, Homo sapiens
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441640 - DNA, 4215 bp, Homo sapiens
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttagggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441641 - DNA, 3279 bp, Homo sapiens
cagcgaaacgcgtgacagaagtggatggctcaggctgtctgcaaaataacagttggtttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441642 - DNA, 4477 bp, Homo sapiens
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccattaatttggcttttaagttgtcttaataaatcaaagtcatttagtgggtaggggaagattcttggtcgggtttgttaggagagaatacatttcttgctgtactggttaaagtagagagcaagctgctgtaaggaaaagatacaaaaccctggtgtctaaaacaaggggtagaagtttgtttttctcaaattcagctcaacggtgag

SEQ ID NO: 441643 - DNA, 4216 bp, Homo sapiens
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441644 - DNA, 1738 bp, Homo sapiens
gagatcaggccactgcactccagcctgggtgacagagcaagactatgtctaaaaaaaaaagtctgaagaaattgcatttctgctactttgtgccccttttaaaacgcaatttttccttaaactaaatgtgtggttattctaaaataacttcttgcctttccatccagagcaaaattaatgttaacaagtctcttaaagtgaaatatgtacactttccagttctgaagtaaaaagggatgggaaccctgtggtgttgagagtaaaataaggtgcctgagataagctacaagtcaagttacaaatagcgacttactactgcttgatattcttcttgtcccaaactggcaatatcataaagcaaacttctgcttaaatatgataccccttacttggttgttttaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441645 - DNA, 1164 bp, Homo sapiens
acccccatctatggcctggtgccatggcatgcgcctgtagtcctggctactcgggaggctgaggtgggaagatagcttaagccaggagtttgagaccaacctgggcaacatagttagaccccacccaggtgattaggtcaattgaatctgacttttgtcaacaaattcttctaatatgttttttaaatgcacaaaatgtcaaagttgagatttaatgatgctttttacaatttcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441646 - DNA, 3095 bp, Homo sapiens
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaa

SEQ ID NO: 441647 - DNA, 2535 bp, Homo sapiens
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagagttttcagaaaactgataggtcaaagagggaaactgatcttctggaagctctgagaaggctacagtggctcataggtggagcgccagcggccagcaaccaagcgaacgttctggacaacggggagatgagcagccacaggaggctgccagttacatgggcatgtgaatgccccaggctggtcctccagacctcataaagacaccagggcaattgtggaggagaaaataagaaaaacagcattttataaacagaaataatcatctcttctaaatattcaggaataaaactacagtttaaatgttctacatttaactctacttttattattttatccagaaaaacaacagtactttttaaaaaacaatgttatttgtattgtttgacatccatgagaacttttaaagtgtaatatattccagaaggattttcagagaatgctttttatagccttaaactgctgtttcacgctatccccataaaatcataaacaggaaatgtcttgccttttaaaataaaggcttagttgcaaatcagtacatagtttaaataatatgtatcttttggaaacacaatcatggcaagttatcagatttttatgaatgcttgaggttttgtgggggttttttaaagccacttatcactaatagataacattgtgaagtttttcaacatatttgcaaacaccagatatgtatccagcattttttagcggttaaattaatgattattaaatatgtagctgttagccttgtcattgacagaatattagtagtgatacaagaacagagcaattgaagctttatttatagtagtgaaaaagtgggaaacgacctgaagcccaaagcaatatgcagagggcgatagaattagtttaatatggatgttgtatagccactaaaaatgatggtttttagactattttaaagcaggaggaaaggtttgcgatatagtagaggagaaaatagtgcctaaggtagtatgatttcttttattatcaaaaaataataatccagaagaagaaagaagttaagtgatttttctttgggtgatagttaagtttatcttctccccctcctccccacacctttttatttttaacaatgagtgtgtgtttagtgaggaaaagagagattgtaaagggaaatggctttgttcttatagaacaatgctagctcttgctagtaaccttaacattttttatagttcttttaaatcagcattcctcctaaaatcctcaaaatctgtaggtcagtgaagtggctaacattggttttaggc

SEQ ID NO: 441648 - DNA, 547 bp, Homo sapiens
caaacgttcattgataatactgattctattgtgaaggtaaataccctttcctaccataccaagtgcttggcttaaacgtttcccctcatttcatgtttaatctgaaagacagctatagaaagggagggtacatgtgagccttgaagtcagaaggcagtactggatttgaatcccagttctgctgctcatttacctaatcatttttcaagcaggttggttaaaccggtataaaacctcaagtcctttatgagtggttatgagaatcacaagtgaaagtgttctataaccaataaatgttctttgtctagaaagttcaagttgattatttagactttaggtagaacccagctttttttcatgtttctctttccacatttgcttaagcatatttagaatgctcagacataacagaacaaaacccatgataagaggaagtagagctaatttagggcctatatttgggagctgaattagtcgaacccaggtgaatagctctgggtgagaaagaaagggtactgtgatgtccactctcatggatctgaaagcc

SEQ ID NO: 441649 - DNA, 417 bp, Homo sapiens
aagcatgtaatgtccctgagccagaagagaagtttaatatggacaaatacacagacctggtgacagtcagcaaaccagtcatttatatttcaattgaagaaatcatcagcacacactcagtaagtggggatggggagccatcttagcaatggacccatgatttaggcatctgttatcttgaaaatgcttaatctctacaggacttattgtacacatgtgctaatactcatattcttaaccctaaaaatctcgcaattatttattccatgactcttatacattaataaaactccttctcccaaacaacaaaattctatttttacataattattccctgactcctagacattaataaaacttctccccaaaaaagaaagtgtacttttggcataatccatttacaaagccagattgtga

SEQ ID NO: 441650 - DNA, 526 bp, Homo sapiens
caattgctgtgtgttttttcctcactccgccttttttccattattttcttttgtcatctgttttatatgtagttatggattgaggtatatagccaaagtactgaagaattcgatccatgagaaattccccgatgcaacagaagatgagctattaaaggtagattttcaagggtaatctcaccatagcttctcctgggggtatgaatcaaaattaccaacatataactttgtaagattattccccatgtatgattatttataataagctgcaggtcttctgtttctaatgactctcaagataattgattaagctgaggttaatttggagatcctagacattattgaaattctttgcattagagcattttgggggcaatgagcattttttcatcaaaaataactttgcaaattatgctattaataatgtgtgattatattcattgcctttattaaactccttgttaggatttacatcagaaaatgatctgctttctcttgggaaatgtaggagaatatatatctttaa

SEQ ID NO: 441651 - DNA, 5764 bp, Homo sapiens
gagggaggagagttcacttttacttcagtgtcagcgcgcggcggccgtggctggctctggcgagagagcaccgagggagtgggtcgcagatcttcgggcggctaggggaaatcggcgagaggcgggatccgagcgcgccggcggggcgcagagcccgcgagcctggccagcgagggtagccgcggggggcgcgccccgggcgggcccccggagacgcgcaggatgccacacgaagagctgccgtcgctgcagagaccccgctatggctctattgtggacgatgaaaggctctctgcagaggagatggatgagaggaggcggcagaacattgcttatgaatatctgtgccacttagaggaagccaaaaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttgtatctgttcaaactaggaatagcaccccagatccaggatttgttgggcaaagtagacttcacagaggaggaaatcagtaatatgagaaaagaacttgagaaatatggaatacagatgccatctttcagcaaaataggtggtattctggccaatgaactgtccgtggatgaagctgcattacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaagaatagctgtatttcagaagaagaaagagatgcttatgaagaactgctgacacaagcagaaatccaaggcaatattaataaagtcaacaggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatgaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacgttatgcaaacacactactctctgttaaactagaagttttatcccaagggcaagataacttaagctggaatgaaattcagaattgtattgatatggttaatgctcaaattcaagaagaaaatgaccgagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441652 - DNA, 4321 bp, Homo sapiens
agcagcttgtattcttagaaacgcagcagacagcaactttagcaggtgatttcaatcaagtcagctgaaatgcactcacttccaggtgatcggccttggttctgttaagaccatttttggatggggtgttttaaaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441653 - DNA, 3077 bp, Homo sapiens
  misc_feature (28)..(28): n is a, c, g, or t
  misc_feature (31)..(31): n is a, c, g, or t
  misc_feature (37)..(37): n is a, c, g, or t
  misc_feature (53)..(53): n is a, c, g, or t
  misc_feature (58)..(58): n is a, c, g, or t
ggggaccgcccccgcccagaattgatangtnttcggngggggttccagttatnatttncacacagatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441654 - DNA, 1262 bp, Homo sapiens
catcactttcttgtcctaaaatctcaagggaagccagactcactggcatttgccttttctttaactcctgccttccttcaaagcctgacttctgtttatcccatgaaacctcctgacaacaccaactcagaagaaaatgcttcttccagagatggagtctcactctgcggcccaggctggagtgcagtggtgggatcttggctcactgcaacctccacctcccaggtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgattttttttaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattcc

SEQ ID NO: 441655 - DNA, 3076 bp, Homo sapiens
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacacagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaa

SEQ ID NO: 441656 - DNA, 1707 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441657 - DNA, 485 bp, Homo sapiens
tgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaaccgggcaagcgacgagcacatcgaggcccgggcatttgacatctggaccggagatgtcaacgacgccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgtgagctccctggggtgac

SEQ ID NO: 441658 - DNA, 423 bp, Homo sapiens
gcaagggagagtggagcagacgtgcccatgtgggatctccccgtcccccccacccccccccaactaggctgatgagcagcgtcaaggacaacgtgggccgcgggctgaacatcgccctggtgaacggtgaggcccctggctgagcgtggcctgccgccctccttccctgctccctccccaggaggcctctgggtgtttgccctcccttcccctcccattcaagatctcccagggaggcctgggaaggagtctgtgcaagcgcaaggctccacagaggagtgacccaatgaacaaaaaagcatgatggcaataaagaactagggaaggttctgggaggttgagggtgcttcatggagagcccccggagggcctcaaatgccagacagaggcaccacggcttggggtgggatgcagctgcctgaa

SEQ ID NO: 441659 - DNA, 1902 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441660 - DNA, 1633 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441661 - DNA, 1805 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441662 - DNA, 1731 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441663 - DNA, 1593 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacagtgcacttgccggcggtcccaacccagcaggagaagtggacatgaggttggcaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441664 - DNA, 2220 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaaaaaaaaaaaaaaaaaaaaaaaaaaaaaaaaaaaaacaaaaaaagggcggggcggcccaataaaatacacacaccgaaggaggccacacaatatcacagaagcaccgccggaatagatgagaacaacggggagcccaaaaaggccacaagaaaaaaacacgaaacacacgcccgagagcataaccagcacacgagcgacggcaacaccgcaagaccgagggacccaccgcggacacaaacccgcaccccgtcgcagggggacacaccaacgcggcacacacaacaccacaaagggcacgaagccccgaagcgcccacaccaacaaaaccaacgcccacacagaggagaacaacacagcacacacagagaggaaaagaaaaagcgacaaaagccacaaacgacgaacaaaccataacc

SEQ ID NO: 441665 - DNA, 1943 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaacagaagaaatgccttcagatgctgttgtcagtgcggagtcagaggtggcggtgtcctctggggtgcgggaggacagattccagagtcttaaccaacctgctcccacagcccgagcagacagccttttgtctccagggct

SEQ ID NO: 441666 - DNA, 1529 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441667 - DNA, 1770 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgacgagaagaggcaacagacaaggaatcagacagagagaccacaaacggaagagcagacttgcgcaagagagacgggagcagggggatagcggcagacaaggacccgaggagcctttgacatgtgggccggagatgtcaacgaccttggttgaagtttattcggccactggcacgaaggcaccgctgtgtgttccggtggagcatatccgattgcggagcttaacctcaatggcatcgcaagatatagaaagaaagaaagtagctcaaaataacaccgactacgaagtcttgggtgcatactaagagatacatcccggaaggaatctgaacctatctctgttcaagcaaaattaataagacagggagccgaaagatgaatattcatgaagcgataatagtcctcctgagatatcgagagatcgaaaaaaaaccatgaaaggcaacagagcaaacaaaatatcaaattactgagattccagaaagcactaaaagatatgggaagcgaggaaggccggcaggaagaaatcatcggggccaggcgaatcggccaaccaaattttcggaggtcatgctatagctggaatgaactaaactcggaggaccctataataataattcttggaccacggctaactctaaatccaaaacgggagtaggggacaaaaggattactggcggaccgcctgaatgccgattgagcgaattgagcggcgtcgccaaaaccctccaaaacgatcattacatttttccactctatggggcgattataccgaaaaaaaccggaatttcttcctattgagaaagcagtttaggctggaaagaaaagccgaactattatagagaaattccccaagcacgggcgacggaaattacaccaaaaattcccaaaaagaacctctgccatccgattatcgggaggggctccaaagggcccgcccccaggggcgacctaacgaaaccgccctgaggaccgactcatggcccagcatcgggcgagcaacaaagctgccattacgaacgggcccag

SEQ ID NO: 441668 - DNA, 734 bp, Homo sapiens
  misc_feature (9)..(9): n is a, c, g, or t
  misc_feature (69)..(69): n is a, c, g, or t
  misc_feature (94)..(94): n is a, c, g, or t
  misc_feature (96)..(96): n is a, c, g, or t
  misc_feature (98)..(98): n is a, c, g, or t
  misc_feature (114)..(114): n is a, c, g, or t
  misc_feature (117)..(117): n is a, c, g, or t
  misc_feature (128)..(128): n is a, c, g, or t
  misc_feature (166)..(166): n is a, c, g, or t
  misc_feature (169)..(169): n is a, c, g, or t
  misc_feature (182)..(182): n is a, c, g, or t
  misc_feature (189)..(189): n is a, c, g, or t
  misc_feature (191)..(191): n is a, c, g, or t
  misc_feature (199)..(199): n is a, c, g, or t
  misc_feature (204)..(204): n is a, c, g, or t
  misc_feature (211)..(211): n is a, c, g, or t
  misc_feature (214)..(214): n is a, c, g, or t
  misc_feature (250)..(250): n is a, c, g, or t
  misc_feature (263)..(263): n is a, c, g, or t
  misc_feature (270)..(271): n is a, c, g, or t
  misc_feature (275)..(275): n is a, c, g, or t
  misc_feature (283)..(283): n is a, c, g, or t
  misc_feature (288)..(288): n is a, c, g, or t
  misc_feature (297)..(299): n is a, c, g, or t
  misc_feature (301)..(301): n is a, c, g, or t
  misc_feature (307)..(307): n is a, c, g, or t
  misc_feature (311)..(311): n is a, c, g, or t
  misc_feature (315)..(316): n is a, c, g, or t
  misc_feature (331)..(331): n is a, c, g, or t
  misc_feature (333)..(333): n is a, c, g, or t
  misc_feature (340)..(340): n is a, c, g, or t
  misc_feature (342)..(342): n is a, c, g, or t
  misc_feature (345)..(346): n is a, c, g, or t
  misc_feature (348)..(350): n is a, c, g, or t
taagcaacnggcccagatgcccaaggcacacggggcacgagggggaggccccaggacacaaaggggagngccacggcgcagcttgaccggagcngnancaggaggcctgtaggnctncacaacctccnacaaccccgggccaggaagcgcctcccctgcgcccccnaancacaatccggganctcccgnangccagtgnacacngaaacgntgnctctccacaggctgggtggggggctcatggggtttnttatggtggttanctctttnntctntatttttntttantgtgtgatnnntntatggnttanctcnntcttctttttttttnanatttttncnctnntnnntcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441669 - DNA, 624 bp, Homo sapiens
caacgtgggccgcgggctgaacatcgccctggtgaacggtgaggcccctggctgagcgtggcctgccgccctccttccctgctccctccccaggaggcctctgggtgtttgccctcccttcccctcccattcaagatctcccagggaggcctgggaaggagtctgtgcaagcgcaaggctccacagaggagtgacccaatgaacaaaaaagcatgatggcaataaagaactagggaaggttctgggaggttgagggtgcttcatggagagcccccggagggcctcaaatgccagacagaggcaccacggcttggggtgggatgcagctgcctgaacaaatggatgaatattgggggactgtttgaaagcgtccagaagggctgccccccacccccggtgctacccgcctgccgtgccctgaggctggcctggcttacccagcagggcccctccctcctgacacaggggtcagcggcgagctcatcgaggcccgggcctttgacatgtgggccggaggtgagttgcagcgcagcgtcttgcattttgactgcagcaaaatgacctgggcagcttcccctgagacactgctctctctgtctgtacttggagcttctcagtcacctc

SEQ ID NO: 441670 - DNA, 1804 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441671 - DNA, 2041 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaacagaagaaatgccttcagatgctgttgtcagtgcggagtcagaggtggcggtgtcctctggggtgcgggaggacagattccagagtcttaaccaacctgctcccacagcccgagcagacagccttttgtctccagggct

SEQ ID NO: 441672 - DNA, 2018 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagtaacagaaaatccttctgtcttgggtccctgtggcctcaccagtaggacacagagtatggaagtgtccccagcctcggcctgagccacatccccctacttgtgtcctgctctgcggtcacttgttctaccatgtgtgctggtcctgacctccccttcagatctcaggtgacctcagggccaggcccatggataacacctgctatccctgcccagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441673 - DNA, 1825 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacgggcccctccctcctgacacaggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441674 - DNA, 1991 bp, Homo sapiens
caacagaaatggattctctccccattctgaaagccagaagtctgaaatcaaagtgtcagcagggcgttactcaccctgaaagttctacaggagggtccttcctgacctccccaggttccagtggccccaggcataccttggcctctggctgtgtcactcctgtctcttcctccactgtaccatggctgtcttccctctgtgtgtctttgtcacttctgttcttataaggacatcagtcatgttgcattaaggacccaacctactccagtatgaccccatctgaactgcaaaggccctatttgcaaacatcacattctgaagtaccacagattagaacttcagcataccttgaggggacagaattcaacccataatagaagccatcctgctccagtcctcccaaccaacccccatcaaaatcgggagacaggctgcaccccctgccacactaccccctgccacactgcctttgctcaggttggcctcatccatgcagctagacccccagcctgacttacttcacccctgctttgttcctggctgtgcagtggcccaggccagccctcagcatcctttcttttctcccaccagtaacagaaaatccttctgtcttgggtccctgtggcctcaccagtaggacacagagtatggaagtgtccccagcctcggcctgagccacatccccctacttgtgtcctgctctgcggtcacttgttctaccatgtgtgctggtcctgacctccccttcagatctcaggtgacctcagggccaggcccatggataacacctgctatccctgcccagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441675 - DNA, 1753 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacgatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441676 - DNA, 1851 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagctggagtgcagtggtgcaatctcggttcactgcaacctctacctcctgggttcaagcgattctagtgccccagcctcccgagtagctgagactacaggtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacgatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccagctagcacggccagtgccaggaccgggccgagggaggccagaccaagggaggcacgcgcgctgccgggcggacagaggctgaggctcacaccccacacccgggcaggagcgctccctggccccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441677 - DNA, 1680 bp, Homo sapiens
agccgccattgccgggcctgcctggccaccctgcgcagcggccttgcgtcctctccgggggcggagcgggtcggcgggcctgacagggaacctccctgaccgagcccacgtctccccacggccagagaaatctccggcccggcccgcatcgccagcccccaggcccggaggaacggcccgagcccaggagaaccacatcttcgtcccagccccggaggctcctgtgggcaagatcgtgagccaacgggttcctgaggcccctcctggccaggcagggtttccccgcgcgtttccgaggagccctgcctggccgggcggctggacaaacaggtcgtagcaccgatcgcgcccgcccccagcaggggtcccgcacaggcttgcccctgacccccacccaaacctgtccttccgctttgcccccaaacagtgcacttgccggcggtcccaacccagcaggagaagtggacatgaggttggcaggccctctccgcattgtggtcctagtcgtcagtgtgggtgtcacatggatcgtggtcagcatcctcctgggtgggcctggcagtggctttcctcgcatccagcaactcttcaccagtccagagagctcggtgactgcagcgccacgggccaggaagtacaagtgtggcctgccccagccgtgtcctgaggagcacctggccttccgcgtggtcagcggggccgccaacgtcattgggcccaagatctgcctcgaggacaagatgctgatgagcagcgtcaaggacaacgtgggccgcgggctgaacatcgccctggtgaacggggtcagcggcgagctcatcgaggcccgggcctttgacatgtgggccggagatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaaggagctggccttccgggacagctgggtgtttgtcggggccaagggtgtgcagaacaagagcccctttgagcagcacgtgaagaacagtaagcacagcaacaagtacgaaggctggcccgaggcgctggagatggaaggctgtatcccgcggagaagcacggccaacacatcggggctccgaggcagtgaccagaacgtggtctcaaggtggtgggggctatgggggctgcagggggtagccctgccgcactttgtcacgggagcccagggtacccgcctccttttcgtaacactgttccccccggtcagcccatctagccctgtcctccattcctcacgccatctccatccccatcttgagtcctggaacggccctgggtgcctgcccctcactgtgcaactctgggagcagcccggcaggttggggcgtcttccagaacctctcccttctggagccactctgcactgcgggctaaacatgtttccagtgtgattccttccagtgagccaaacccggtggctgcttcatgagcctgactgcctctcgcctgctctcagcaggaagggacccctggagcaggctggcccggggtggtgaagtagctggagcccgatcacagtcccgcggtttgtcagggggcccaccttctagatgaccccttaataaagtgatggccccacagaaaaaa

SEQ ID NO: 441678 - DNA, 181 bp, Homo sapiens
tgggagggtgctcagtggtgcctgatgacccctgttccgtggcacctgcccccccagatgtcaacgacctgttgaagtttattcggccactgcacgaaggcaccctggtgttcgtggcatcctacgacgacccagccaccaagtaggtgcttggggaggccagcctcagccttgcccttct

SEQ ID NO: 441679 - DNA, 1955 bp, Homo sapiens
agcggggacctccaggattaccgctgctccagggactcagccccgagccccgtgccccatgagctggtgatcaccatcgaactgccgctgttgcgctcggccgagcaggcggcgctggaggtaacgagaaagctgctgtgcctcgactcgaggaaacctgactaccggctgcggctctcgctcccgtacccagtggacgatggccgcggcaaggcacaattcaacaaggcccggcggcagctggtggttacgctgccagtggtgctgccggccgcgcgccgggagcccgctgtcgccgtcgccgccgccgcgccggaagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaaggtaacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaatttttgctttgtcattaataaaatttaaaaatattcaaaaa

SEQ ID NO: 441680 - DNA, 2330 bp, Homo sapiens
agcggggacctccaggattaccgctgctccagggactcagccccgagccccgtgccccatgagctggtgatcaccatcgaactgccgctgttgcgctcggccgagcaggcggcgctggaggtaacgagaaagctgctgtgcctcgactcgaggaaacctgactaccggctgcggctctcgctcccgtacccagtggacgatggccgcggcaaggcacaattcaacaaggcccggcggcagctggtggttacgctgccagtggtgctgccggccgcgcgccgggagcccgctgtcgccgtcgccgccgccgcgccggaagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggaggaaaggttatttgtcaatgaagaaaatgttaatgagtttcttgaagaggtcctgagctctccattcaaacagtctatgtccttgaccccaccattaattgaagttcttcaagttactgataataagattcaaattaatgcaaagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaaggtaacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaatttttgctttgtcattaataaaatttaaaaatattcaaaaaaaaaaaaaaagagatcagcaagaacaacaccaacaacactggtgttgtgggcgccgccctggggcccatgtagaaagaagttttttttaagcaaccacattctgcgttgtgggccgcagcgggggccccaagtggtgttatgtggaacacgtggtggtcccacagcgtcggttgccccaaggagaaacactccgcggccagaaacatatgggcgttggtgatttctcaccg

SEQ ID NO: 441681 - DNA, 1072 bp, Homo sapiens
taaactcttaacataacccacttactctttatatcaatacaacctcagtaagagaaaggttatttgtcaatgaagaaaatgttaatgagtttcttgaagaggtcctgagctctccattcaaacagtctatgtccttgaccccaccattaattgaagttcttcaagttactgataataagattcaaattaatgcaaagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaaggtaacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaatttttgctttgtcattaataaaatttaaaaatattcaaaaa

SEQ ID NO: 441682 - DNA, 2099 bp, Homo sapiens
agcggggacctccaggattaccgctgctccagggactcagccccgagccccgtgccccatgagctggtgatcaccatcgaactgccgctgttgcgctcggccgagcaggcggcgctggaggtaacgagaaagctgctgtgcctcgactcgaggaaacctgactaccggctgcggctctcgctcccgtacccagtggacgatggccgcggcaaggcacaattcaacaaggcccggcggcagctggtggttacgctgccagtggtgctgccggccgcgcgccgggagcccgctgtcgccgtcgccgccgccgcgccggaagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggaggaaaggttatttgtcaatgaagaaaatgttaatgagtttcttgaagaggtcctgagctctccattcaaacagtctatgtccttgaccccaccattaattgaagttcttcaagttactgataataagattcaaattaatgcaaagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaaggtaacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaaagtataaaattaaaatttgcaattttttttaaaaaattgcaattttgattctcatgggggaaattggagataatttttttttttttgcctctggagtttaaagtttccttatggagataagttttgtgattcctgtaatagatgtgtatgttttctatttgagagttaaaacatttgagagttaaaacatttagttttaatacaacctatgtatatatacttctgtgttaatttttgctttgtcattaataaaatttaaaaatattcaaaaa

SEQ ID NO: 441683 - DNA, 2301 bp, Homo sapiens
  misc_feature (2087)..(2087): n is a, c, g, or t
agcggggacctccaggattaccgctgctccagggactcagccccgagccccgtgccccatgagctggtgatcaccatcgaactgccgctgttgcgctcggccgagcaggcggcgctggaggtaacgagaaagctgctgtgcctcgactcgaggaaacctgactaccggctgcggctctcgctcccgtacccagtggacgatggccgcggcaaggcacaattcaacaaggcccggcggcagctggtggttacgctgccagtggtgctgccggccgcgcgccgggagcccgctgtcgccgtcgccgccgccgcgccggaagagtccgcggaccggtccggaactgacggccaggcctgcgcttccgctcgcgagggggaggcgggacccgcgaggagtcgcgcggaggacggaggccacgatacctgcgtggctggggctgcgggctccggggtcaccaccctgggcgacccggaggtggcgcctccgccggccgcagctggagaggagcgtgtccccaagccgggggagcaggacttgagcaggcacgcggggtcaccgccgggcagcgtggaggagccatctcctggaggagaaaactcacctggtggcggaggctccccttgtttgtcctcccggagcctggcgtggggttcttctgcgggaagagagagtgcgcgcggagatagcagtgtggaaacacgcgaggagtcggagggcacgggcggccagcgctcagcctgcgccatgggtggtcccgggaccaagagcggggagcctttgtgtcctccgttactgtgtaatcaggacaaagaaaccttgactctgctcattcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggaggaaaggttatttgtcaatgaagaaaatgttaatgagtttcttgaagaggtcctgagctctccattcaaacagtctatgtccttgaccccaccattaattgaagttcttcaagttactgataataagattcaaattaatgcaaagttgcaagaatgtagtaactctgatcagctacaaggaaaggaggaaagagtaaatgaagaaagtcatctaactgaaaaggaatatatagaacattgtaacacccctacaactgattctgattcatctatagcagttaaagcactacaaatagatagctttggtttagttacatgctttcaacaagagtctcttgatgtttctcaaatgatacttggaaaatctcagcaacctgagtcaaaaatgcaatctgaatttataaaagaaaaaagtgctacttgttcaaatgaggaaaaaggtaacttaaacgagtcagtaataactgaagagaaagaaacagatggagatcacctatcttcattactgaacaaaactacggttcacaatatacctggattcgacagcataaaagaaaccaatatgcaggatggtagtgtgcaggtcattaaagatcatgtgaccaattgtgcattcagttttcagaattctttgctatatgatttggattaattctatataattttggacttttaaatattaaggttaaaaaatacctgtatctaaaattgattctgttaactgttgtcttaaaactaaaggtattaagtcataacttaacttcgcatctttttcaaaattgcgcttcgatctcacggggaacatgggatactcttttattggccggggttaagttcctagagatagctggaacgcagaaagggtgttctatggaggaaccatgaagaaacatttatacccgcttatccgtgatgcggcatatatatctcgaaaaacagcccgtcgtggttatttatgattgtcttcatttttctcgcttacacctcatacactcgccacaacacaantgggaaagacaagatacagacgcgaccaatacaagcacagccacacaccgacacaagcactacaaaccacaacacagcaactacaagacacggatacgacactcaacacgcaaagaacgaggcagaagcaacagacaaagagaagactaccacaccgaagaacaaacgacagcacaaacaagcaagaacgagcagacataaagcagacacagcc

SEQ ID NO: 441684 - DNA, 333 bp, Homo sapiens
ttcaggtgcctcggatccagccgcaaagtcttcaaggagatttgaatcccctctggtacaaattacgcttctccgcacaagacttagtttattccttctttttgcaatttgctccagagaataaattgagtaccacagaacctgtgattagcatttcttcaaacaatgcagtgatagaactggcaaaatctccagagagccatggacattggagagagtggtattatggtgtaaacaacgattctttggaggtaacagttctttccagagtcctcatatttgaaatatcccatctcactttaaaaatttgctattaccggccgggcgcggtgg

SEQ ID NO: 441685 - DNA, 638 bp, Homo sapiens
cccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttcc

SEQ ID NO: 441686 - DNA, 334 bp, Homo sapiens
accctctcaactagaacttttgtaatgccatgataccatcagtgataaagtataccacatactaggcttacctctctgggcttccgttgttttctgatttgggcctctgtaattgcccactgtctcagtagctgttttatgccttcagacaaatgaattgtgtgtgtgtctttctatttggacaacagggttggttaaaccatttattccaccattggcaggagaggaattcctatgctcattttattagtttctttttaaattgttccgaattatatatttgttctaatacttttaagatcatctatagaaagtaatgtatatattggccctt

SEQ ID NO: 441687 - DNA, 361 bp, Homo sapiens
tgttgactcgtagaggatccctactaaatggctgtgtactgttttacaaggccatctgtctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttcc

SEQ ID NO: 441688 - DNA, 345 bp, Homo sapiens
tatttgttctaatacttttaagatcatctatagaaagtaatgtatatattggccctttttctaggtgctaccatattggggaaatcctcatgatagaaaagtcatcagaaggttctggagtcaggtaacattctacttaaactgcatacatacgtaccgtacatgcagtcattatttctctaattgatgtggataatttcttttagacaaaaatcttcttatctattatatatttctggacactgatcaagtttccatttttctgatacaatacttttcctgttgtaggcaatcagctggacttgatttccaggattaattaagaatctttttttttgagacaag

SEQ ID NO: 441689 - DNA, 495 bp, Homo sapiens
cccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtaaatatcagtccaaccaaaacatctattgctctttaaaataaactttttgactctc

SEQ ID NO: 441690 - DNA, 2072 bp, Homo sapiens
cacgaggcttgcggcaccgcccacccacaccccgtctgccccttgaccccaccacacgccgacgccatgcagtccagtggggagtcggaggcagcctccttcctgcctccgactccccactggactgcatggcgacggcgtgtggtggggcagtcagctaagccatttgcctaaggggctgtcgggcatctgcgtgctggggaccgacagtgtgggtgtgttaggaggatctgtatggagcacattgctgcctctggctaggacagggtggaaagggtggcgtggctacagcctgacccatgggcaccgtcctaccctttgttctgtgcttccgagtgtcagtcatgtgctggggtctgtgggcccatgactcagacggtgagctctgaccttcctgagccagggctttgctgtagttgtgcctggctcaggagctctaggacaaggggaccgctccaggtctgcatctacggtgtggcagggcccctcggcactcttgtgcactagtgtcatctttcccattgaaatgactgtgaggaccagaatgtgcacatgcagatgggcagctacttgtctgccttggccctttattacacaacttgctgggggtggagatgccaccccccggcagtcagagcccctttatgatgtcatggggctggttacatgactgccaaggggtgctgctggccacactgcactagcaagtttgccagatggaggacaagcgatcattgagtatggctcgctgtgaagaaagaaattcgagaggacaggatcatggcttggaaagggtgcctttccctccccagttgcagtcagagacctaccttcacccagcagatccttcccctgcctgggacgacccggggtccactgggagccctaacttgaggctgctgacagaagaaatcgctttccaacctctggccgaggaagcttcgttcagaaggccgcaccctgacggtgacgtcccgccccagggagaagataatctcctctccctcccctttccacagaaactgtggagactggtcagcagcaaccagttttcgtccatctggtgggatgacagtggggcttgtagagtgatcaatcaaaaactctttgaaaaggagattctcaaaagggacgtcgcacacaaagtgtttgccacaacttcgataaagagcttcttccgccagctaaacttgtatggcttccgaaaacggcgtcaatgcactttcaggaccttcacccgcattttctccgcaaaaaggctggtctccatcttgaataagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaagtcttca

SEQ ID NO: 441691 - DNA, 1593 bp, Homo sapiens
tgggctctggggcctggtcgggtggaagtcccaggactgcctcctgggaagtgggcgacctcaggcagggtgtggggccatcgctgtgggcctgtgtccccctctgggtggaggtgacatgaactaagagtgaatgtggggagagggctgaggatggtgcgggcccctctcgagtgtgtaaaatatcacaggtgccaagtagccgtatctgcgtgtcgtcctccccggggccagccatgtcatctggcgcttgctgtgtccccctgactccacagcacattaccctgtgaggtgagcaggccaggggagtctggtatttgtaccactgtcaccctagctggtgtctggagaggtgctcaagtggaagcactgaaaggcgcctggcgcaggaggtgcagatgctcctgctgcccttggtaggtgggcccctggtgtggaagagccagtacccagggcctccaacacagccggggtgcattctgttgccagctgacactgcatgggggaggcccagaatcttcttccctcctggtctgcaacttcaaagaccctttccgccggccatggacaccctaatctgccattttgaggctttttccaagacggaaaggcccgccacaacttggtaaaccttgacgatgtgaacgcgagtccccagcttcctttggggactgggaccttttccagaaaggcctcctgggccagtagagttctcttgcacaggggcgtagatggttggtagttgtagtccatccttgtgacttgcagtttccttttgtttatttaaactttgacttatagttagagttctactgccatccttactttcaaagagactcccctcacctcctcgtgaggatgaagagaagagtgggtgtcaagtctgcaccaagacatcaggaggaggacaagccagaagctgctggatcctgtctggcaccagcagacactgagcaacaagatcacacgtctccgaatgagaatgaccaggtcacaccgcaacaccgggaaccggccggtcccaacacccaaatcaggagtggctctgctccaccagcaactcctgtgatggtgcctgattccgccgtggcgagtgacaacagtccagtgacccagccggccggcgagtggtcagagggcagccaggctcacgtcactccggtggccgctgtccctgggcctgcagcgctgcccttcctctatgtccctggatctcccactcagatgaattcttacgggcctgtggtggcccttcccacagcgtcccgtagtacccttgccatggacaccacaggacttcctgcacctggcatgctgcccttttgccatctctgggtaccggtgaccctagtggctgctggggctgcacagcctgctgcctccatggtcatgttcccccatctcccagctctgcaccaccattgcccccacagccaccgcacgtcacagtacatgccagctagcgatgggccccaggcgtacccagactacgcagaccagagcacatagagggcagcatttgggcagaatatgtgctggtcaataaatgtgtcagaaaatgagtaattttctgactgcacaaaaaagtcttca

SEQ ID NO: 441692 - DNA, 1111 bp, Homo sapiens
gccacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatagaaaaaa

SEQ ID NO: 441693 - DNA, 1134 bp, Homo sapiens
gccacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcagtcagtgagtctcttcttccctaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatagaaaaaa

SEQ ID NO: 441694 - DNA, 995 bp, Homo sapiens
gccacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttacacctaaaatatccctcccctaggacagtggtgactggtccttccaccacactcagtcttggagagcgagctgtccagccacagaaatgaggtgtggtgcgtggcttcctgtccccacagccagccctgtggggctcaagccgaagaacgggccctcagactctgggactacgttccagaagcccagaatcatgattgaccagggctggacccatacatgaacgctgcaactgccgcctaaactgccgcataaacggctcccacgcagcggaatgggacacactggaaaccggcctcacacacaccgtgcgcaaccccacccaaacaccacaatcaacacctccacacttgcttacaa

SEQ ID NO: 441695 - DNA, 1206 bp, Homo sapiens
agggaggttgagtggcagctctgtggtttgaggaaggtttggcttctcataagcatcactaaggataagtaggtaaatctggctggtaggatgagggtttttaaaatgctagaatgaagaggtcttgtcttggctaccgatttctaaattgactatcctagttttacccagactgttctttcacttactttataataaagatcccttcaatattttgcatggggcacttcctggatttaggcccttctatatttgaagatggggtagtgttcaaccagtttgtatacagacctttaattaattcctttctttttaattagtttagatttaactaatccctctactgtcttctatcatctatgaacttttgctgcctctgagctaaggcccagctgggccggttggctgcctctgatggaacttcctccacatgttttctaggtggtgacattctctagtgttttattagtcacttagctttttgtcttttagaatttggttgacgtctcttgtttattgattttttttccattccctttgttgtttgtgaatttacatacttcgacattttttctttaaaaaaattgtgaaatatttgagcatacagaaaagtagagagaatattttcaccaactcttgtttgagtgggcacttttcgtgctttttgggcagctagcactgtttgaacacctgctttttggcaacttcccactctgtggatctcgccttacccagtagaagacggcaatttaatctcctgcccttccttgcagctgtggctcagacaggtagcatgggctcaccaattagacataactgtgtgaaatctggaagcaagtactttgcagacaagagtagtatgagatacattttgttgaacggagcagtgatgtggttttcaaggcagcagtggcagaggtcccatgtaatggtgcaaggtgtggaggctttgcttagcagtttttcccccgcagctgctccaaggtataaaaatgggcatttttgggggctccgtagtcctgacctccacgcctgtgacttgtgagccattttattctgtttgtttaaactagctagtgtagatcctgttgtttgtaaccaagagtgttgacatacagccactatttaattgtaaccactgtcaacctttttccttatttacttcagatccttttgtgtttaaataaaggaaaagctgcacatcca

SEQ ID NO: 441696 - DNA, 510 bp, Homo sapiens
atagatttctggcagtggaattactgtcaggtgctaccagatgctggcttcccaaaggttttgccaagtgttactcccaataactgtctaagagtgcctgtttccccacaccttgagtaagccttggttatcagtcttacaaaaatattttgccaagagtagtatgagatacattttgttgaacggagcagtgatgtggttttcaaggcagcagtggcagaggtcccatgtaatggtgcaaggtgtggaggctttgcttagcagtttttcccccgcagctgctccaaggtataaaaatgggcatttttgggggctccgtagtcctgacctccacgcctgtgacttgtgagccattttattctgtttgtttaaactagctagtgtagatcctgttgtttgtaaccaagagtgttgacatacagccactatttaattgtaaccactgtcaacctttttccttatttacttcagatccttttgtgtttaaataaaggaaaagctgcacatcca

SEQ ID NO: 441697 - DNA, 1061 bp, Homo sapiens
cgtgtgtggctcttctctggagaaatgttcaagggccccttgtttaattggctctttcctcttcatggtggagttgtgggagttctgggcatattctgggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagacactcccactcgccctgtgtatctgtggcctagccctagcagggtaggcgggaggaggggaaggagctccctcagcagccgccgccatctgcagaccggacaacgttagggtgagtcaggcatttccgctcagggagtgcacaggtggcagctgggaccaagggtggctggggtgcccccccaccaccatgggctgaggcccctccgcgtagcagcttccagctctgcctcaaggccgggccccagctctggggcttccctttgctgatggaacccggatggaggcacaggggctggggggactgtcctcacagataagggtgcatcgaggagagactgccctctgtgcccatctctccagggccatagaaatacattccatagacctaagcagtatttgaatttttataacaatagcatatgtgtttcttatgtgatttactagaaacaatttaatttctcgagttgtaaaaaggtgtattttaaacctgtgtaaaggtacctggagatcattgtcattcagaataa

SEQ ID NO: 441698 - DNA, 1212 bp, Homo sapiens
  misc_feature (133)..(133): n is a, c, g, or t
  misc_feature (136)..(137): n is a, c, g, or t
  misc_feature (141)..(143): n is a, c, g, or t
ggcccggggttaatcggacgaggatctggcggcctatgacagcgagctgaccccggccgagtactcaccccagctgacgcggcgcatgcgggaggctgaggagatggtgcagaaggtgcacagccacagcgcnganntggnnnctcagctgtcgcaggccctggaggagctgggaggccagaaacaaagagcagacatgctggagatggagctgaagatgctgaagtctcagtccagctctgccgaacagagcttcctgttctccaggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcacgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctccccta

SEQ ID NO: 441699 - DNA, 754 bp, Homo sapiens
ccctccctcactccgtgcctcttgtccgtgcccgctgggacaccatggggctcggctcgggatggtgggaccagcgcttagtaagacccctcagccctaggcaccgtgtgagcactgctcacgtggcagagctggaatgggggccgggcacacactccctggcccacgtgttccacggacgtgctgcagaggtccccggccctccagggcaggccctctctgcttccagaggggcaggtgagccccaggccaggccaggccagccggggtctggactggagtgcagtggccacaatggacgccgcgagtgtcttcattaagagccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctccccta

SEQ ID NO: 441700 - DNA, 226 bp, Homo sapiens
  misc_feature (2)..(2): n is a, c, g, or t
  misc_feature (18)..(18): n is a, c, g, or t
  misc_feature (20)..(20): n is a, c, g, or t
  misc_feature (24)..(25): n is a, c, g, or t
gngagagagagagagagnanagannagagagagagagagagagagagagacagcccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctccccta

SEQ ID NO: 441701 - DNA, 1337 bp, Homo sapiens
  misc_feature (133)..(133): n is a, c, g, or t
  misc_feature (136)..(137): n is a, c, g, or t
  misc_feature (141)..(143): n is a, c, g, or t
ggcccggggttaatcggacgaggatctggcggcctatgacagcgagctgaccccggccgagtactcaccccagctgacgcggcgcatgcgggaggctgaggagatggtgcagaaggtgcacagccacagcgcnganntggnnnctcagctgtcgcaggccctggaggagctgggaggccagaaacaaagagcagacatgctggagatggagctgaagatgctgaagtctcagtccagctctgccgaacagagcttcctgttctccaggaggaggcggacacgctcaggttgaaggtcgaggagctggaaggcgagcggagtcggctggaggaggaaaagaggatgctggaggcacagctggagcggcgagctctggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagacactcccactcgccctgtgtatctgtggcctagccctagcagggtaggcgggaggaggggaaggagctccctcagcagccgccgccatctgcagaccggacaacgttagggtgagtcaggcatttccgctcagggagtgcacaggtggcagctgggaccaagggtggctggggtgcccccccaccaccatgggctgaggcccctccgcgtagcagcttccagctctgcctcaaggccgggccccagctctggggcttccctttgctgatggaacccggatggaggcacaggggctggggggactgtcctcacagataagggtgcatcgaggagagactgccctctgtgcccatctctccagggccatagaaatacattccatagacctaagcagtatttgaatttttataacaatagcatatgtgtttcttatgtgatttactagaaacaatttaatttctcgagttgtaaaaaggtgtattttaaacctgtgtaaaggtacctggagatcattgtcattcagaataa

SEQ ID NO: 441702 - DNA, 949 bp, Homo sapiens
  misc_feature (8)..(8): n is a, c, g, or t
  misc_feature (10)..(10): n is a, c, g, or t
  misc_feature (54)..(54): n is a, c, g, or t
agggacgncnaagcgacgtgtttgcaacccggcttccctctgcgcggctctgcnatcgtgtcatgggccggaggtcctggtccagggtgactatgaccagagcaggaccaaagtgctgcacatgagcctgaaccccaccagtgtggccaggcagcgcctgcacgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctaaaaagaagaaaaatgacctcggtggcctca

SEQ ID NO: 441703 - DNA, 531 bp, Homo sapiens
cgtgtgtggctcttctctggagaaatgttcaagggccccttgtttaattggctctttcctcttcatggtggagttgtgggagttctgggcatattctgggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctccccta

SEQ ID NO: 441704 - DNA, 919 bp, Homo sapiens
  misc_feature (8)..(8): n is a, c, g, or t
  misc_feature (10)..(10): n is a, c, g, or t
  misc_feature (54)..(54): n is a, c, g, or t
agggacgncnaagcgacgtgtttgcaacccggcttccctctgcgcggctctgcnatcgtgtcatgggccggaggtcctggtccagggtgactatgaccagagcaggaccaaagtgctgcacatgagcctgaaccccaccagtgtggccaggcagcgcctgcacgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctccccta

SEQ ID NO: 441705 - DNA, 1284 bp, Homo sapiens
ccctccctcactccgtgcctcttgtccgtgcccgctgggacaccatggggctcggctcgggatggtgggaccagcgcttagtaagacccctcagccctaggcaccgtgtgagcactgctcacgtggcagagctggaatgggggccgggcacacactccctggcccacgtgttccacggacgtgctgcagaggtccccggccctccagggcaggccctctctgcttccagaggggcaggtgagccccaggccaggccaggccagccggggtctggactggagtgcagtggccacaatggacgccgcgagtgtcttcattaagagccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtagcctgcaggctcgggggcatagccggagccactctgcttggcctgacctgcaggtcccctgccccgccagccacaggctgggtgcacgtcctgcctctccagccccacagggcagcagcatgactgacagacacgctgggacctacgtcgggcttcctgctggggcggccagcaccctctccacgtgcagaccccatgcgtcccggagcctggtgtgtgggcgtcggccaccagcctgggttcctcaccttgtgaaataaaatcttctcccctagacactcccactcgccctgtgtatctgtggcctagccctagcagggtaggcgggaggaggggaaggagctccctcagcagccgccgccatctgcagaccggacaacgttagggtgagtcaggcatttccgctcagggagtgcacaggtggcagctgggaccaagggtggctggggtgcccccccaccaccatgggctgaggcccctccgcgtagcagcttccagctctgcctcaaggccgggccccagctctggggcttccctttgctgatggaacccggatggaggcacaggggctggggggactgtcctcacagataagggtgcatcgaggagagactgccctctgtgcccatctctccagggccatagaaatacattccatagacctaagcagtatttgaatttttataacaatagcatatgtgtttcttatgtgatttactagaaacaatttaatttctcgagttgtaaaaaggtgtattttaaacctgtgtaaaggtacctggagatcattgtcattcagaataa

SEQ ID NO: 441706 - DNA, 1070 bp, Homo sapiens
atctctcggccctttcttgtctagatcatattatcttaccttgataaacctttccaaattttctggtcttctatctcgttaaatgcttttgtttttttcctctcaacaaacctgccattctctgagactcccttaagctgcagaacgggaccgaattagcagagtctgactcagacgaagtgagatgggagtgccgaatgacctgagggcactgaattcacttgtgggggttactagctccttacgctttcatttcctcatgaatttagtcactgatcaaagctttactgagcccctgctgcacgccaggagccctgtgctgggggagcggatctgtgcggagtctactgtgatcttctccaggagcactggggagaatgggcagctgttgggatgttgggaagtggtcaggagtctctgggaagaggtaatatgtgggctaggaacacatttccaaggtggagaaggagacaaagcttgggaggattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggtccactgtaacttcaaaggggtgaatggtacaacccatggctgataagaatgtccttgttggagctgaggtcatttcttcaggattatagccatcaaattaaccatggaaccctggaaatcaacaatttgcaggtctttctaattgacgtcttaactggattagaaggtttcccagtcagcccatgactcctctgagcctcctgggagctctagagagagtgctttcagttgccttgattctacatttctagcctgaaaagattcttgttttgaaaatggttcctacggtagtgtattcactttgtttgttttttctcttgagaaataagacatgaataactaggtactttaggaggtacaaggaggaataagacttttcttttactaaagtagtaagactgtcctggtgctctggcc

SEQ ID NO: 441707 - DNA, 3184 bp, Homo sapiens
  misc_feature (12)..(12): n is a, c, g, or t
  misc_feature (15)..(15): n is a, c, g, or t
gcagctctcgtngcnactgccaccgccgcgccgtcactgcgtcctggctccggctccggccatgcagccccgcggcgcccaggcgcccggtgtgcagctgctgcccgcgctggccctaatgcgattgctgctaggagcggggccccaaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaag

SEQ ID NO: 441708 - DNA, 3064 bp, Homo sapiens
  misc_feature (12)..(12): n is a, c, g, or t
  misc_feature (15)..(15): n is a, c, g, or t
gcagctctcgtngcnactgccaccgccgcgccgtcactgcgtcctggctccggctcccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaag

SEQ ID NO: 441709 - DNA, 2941 bp, Homo sapiens
  misc_feature (12)..(12): n is a, c, g, or t
  misc_feature (15)..(15): n is a, c, g, or t
gcagctctcgtngcnactgccaccgccgcgccgtcactgcgtcctggctccggctcccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaag

SEQ ID NO: 441710 - DNA, 460 bp, Homo sapiens
ggccacgaggccggccacgaggttttttccctctcttgcggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctgctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441711 - DNA, 505 bp, Homo sapiens
ctactactactaaattcgcggctgtcgacgcacagcacatcgctgaggattcagaccgcaaatatgaaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441712 - DNA, 1781 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441713 - DNA, 1935 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441714 - DNA, 2011 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441715 - DNA, 2401 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagaggtaaagatacccgggggtgacaagtgagcccattggccctggggccttccacacagtgggaaggtagcatcctaggcttggggctgtagggacaggccctgttctctgacccctgcccgctgcccccagccgagccagacagctggaggaggaacttcgaaccatggaccaggccctcaagtccctgatggcctcagaggaggagggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaataaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441716 - DNA, 2857 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggtccatgctgttttcctgccctccagagagcacctctatcgccaccacggagcactggttcactcctgacaccctggcacttactgacacccccagcccctgcactgagcccacccacaaaacaccatggcccacgctgaaacccctctgcacaggcactcccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccatggggccctgaggtccgtgaatgcatgtgtcttccttgacccactccatgtctatatgtcaccttcccctggccctgcctccccacgtctcccccttgtgtctcccttctccctcacctgctgcttcccctcacaagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441717 - DNA, 2498 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggtccatgctgttttcctgccctccagagagcacctctatcgccaccacggagcactggttcactcctgacaccctggcacttactgacacccccagcccctgcactgagcccacccacaaaacaccatggcccacgctgaaacccctctgcacaggcactcccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441718 - DNA, 1847 bp, Homo sapiens
  misc_feature (1827)..(1827): n is a, c, g, or t
  misc_feature (1833)..(1833): n is a, c, g, or t
  misc_feature (1837)..(1837): n is a, c, g, or t
  misc_feature (1841)..(1841): n is a, c, g, or t
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaaaaaaaaaaaaaaaaaaaagaaaaaaaaaaaaaagaaaaaaaaaanaaaaangaanaatnaaaaca

SEQ ID NO: 441719 - DNA, 1034 bp, Homo sapiens
ctactactactaaattcgcggccgcgtcgacccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441720 - DNA, 2205 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaataaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441721 - DNA, 1233 bp, Homo sapiens
ggaccgtgctcgtatgaggtcggtgaaactggagcggcgagaagaaggcacgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaataaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441722 - DNA, 573 bp, Homo sapiens
gaatgatatctgaaaccgggacgaggagtgaggctgcagataggtggccgcgagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441723 - DNA, 803 bp, Homo sapiens
gagaaatgaaggatctgtggtagcgctgtactgatggcgtgtgtgtgtcccctaaagtattccaccaaagaagataaatatgaagaggagatcaaactgttggtaaatgtggggacctagaggaggagctgaaaattgttaccaacaacttgaaatccctggaggcccaggcggacaaggtagaggggagcagaggggcagtgaggatggggtcccacaggggagggaggtgaggggcccaaggcagggaggggctgggtgttcaacggaggcaagatgaccaggagcctacggggtacaatggagaaatgaaggatctgtggtagcgctgtactgatggcgtgtgtgtgtccccaaaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441724 - DNA, 2163 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagagcacctctatcgccaccacggagcactggttcactcctgacaccctggcacttactgacacccccagcccctgcactgagcccacccacaaaacaccatggcccacgctgaaacccctctgcacaggcactcccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441725 - DNA, 2522 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagagcacctctatcgccaccacggagcactggttcactcctgacaccctggcacttactgacacccccagcccctgcactgagcccacccacaaaacaccatggcccacgctgaaacccctctgcacaggcactcccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccatggggccctgaggtccgtgaatgcatgtgtcttccttgacccactccatgtctatatgtcaccttcccctggccctgcctccccacgtctcccccttgtgtctcccttctccctcacctgctgcttcccctcacaagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441726 - DNA, 1857 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441727 - DNA, 2299 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaataaatgtggggacctagaggaggagctgaaaattgttaccaacaacttgaaatccctggaggcccaggcggacaaggtagaggggagcagaggggcagtgaggatggggtcccacaggggagggaggtgaggggcccaaggcagggaggggctgggtgttcaacggaggcaagatgaccaggagcctacggggtacaatggagaaatgaaggatctgtggtagcgctgtactgatggcgtgtgtgtgtccccaaaagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441728 - DNA, 2504 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctgctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggtccatgctgttttcctgccctccagagagcacctctatcgccaccacggagcactggttcactcctgacaccctggcacttactgacacccccagcccctgcactgagcccacccacaaaacaccatggcccacgctgaaacccctctgcacaggcactcccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccatggggccctgaggtccgtgaatgcatgtgtcttccttgacccactccatgtctatatgtcaccttcccctggccctgcctccccacgtctcccccttgtgtctcccttctccctcacctgctgcttcccctcacaagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441729 - DNA, 1473 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctgtggaagggagggggactcctctaggagatcgactatcaccc

SEQ ID NO: 441730 - DNA, 1582 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctgctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441731 - DNA, 1319 bp, Homo sapiens
  misc_feature (1263)..(1263): n is a, c, g, or t
  misc_feature (1294)..(1294): n is a, c, g, or t
  misc_feature (1306)..(1306): n is a, c, g, or t
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagaggcagataggaagtatgaagaggtggctcgtaagttggtgatcattgaaggagacttggaacgcacagaggancgagctgagctggcagagtctaagtgttctnagctggaggagnagcttgaaggaat

SEQ ID NO: 441732 - DNA, 1119 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagtgaccccaaccacaacacccaccggcacacagaccccaaccacgacacccatcaccaccaccagcagggtgaccccaaccccaacagagtgcctcagagtagagagggtccaagcaaggaagaccacaaagatgataaggatgatcaatgcgagcagcagcaccgccatcacagcccccacgatcccatacacgaggctcttggcgatgttgacattcacaggtctctcc

SEQ ID NO: 441733 - DNA, 418 bp, Homo sapiens
actgatggcgtgtgtgtgtccccaaaagtattccaccaaagaagataaatatgaagaggagatcaaactgttggaggagaagctgaaggaggtgagagtcctcttccagttcccagtctcccctcaagccaccctaatccttgccagagacggcctgtggcaggacacttgagggttgggatggacaagaagcttgacttaggcagtagtctgtgggagggcctaattctttgccatttctcccatcctgcctttacccccaggctgagacccgagcagagtttgccgagaggtctgtggcaaagttggagaaaaccatcgatgacctagaaggtaaaagaagcctttataagtaggtccacacctgccgtgattatcagtctgtcctgtaccttctcatcccattttatttgccacc

SEQ ID NO: 441734 - DNA, 1108 bp, Homo sapiens
gttttaaaaaagaaaaggggggcggagaattaaaaaaaaaaaaaaaaaaaaaaaaaaaaaaaaaaaaaaaaaaaaagcgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441735 - DNA, 2272 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaataaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441736 - DNA, 2453 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaataaatgtggggacctagaggaggagctgaaaattgttaccaacaacttgaaatccctggaggcccaggcggacaaggtagaggggagcagaggggcagtgaggatggggtcccacaggggagggaggtgaggggcccaaggcagggaggggctgggtgttcaacggaggcaagatgaccaggagcctacggggtacaatggagaaatgaaggatctgtggtagcgctgtactgatggcgtgtgtgtgtccccaaaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441737 - DNA, 1983 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggaaaaaaaaaaaaaaaaagggggcctttggggattgcttttggggggcc

SEQ ID NO: 441738 - DNA, 2320 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaataaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggaaaaaaaaaaaaaaaaagggggcctttggggattgcttttggggggcc

SEQ ID NO: 441739 - DNA, 1835 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaacaggtcggggggggggactggggtgggggtggtgttgtggggggtgtggggtga

SEQ ID NO: 441740 - DNA, 1792 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgactggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttgg

SEQ ID NO: 441741 - DNA, 2000 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaacggtgaccggcgacttcgaagtcgccggtcaccgttggggaagtccccggtcaccgttgggatgtcttaaaaaaaacaaaatttaatagaaaaaattaggtatggtggcgcatgcctgtaatcccaagggtgaccggcgactt

SEQ ID NO: 441742 - DNA, 2522 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagagcacctctatcgccaccacggagcactggttcactcctgacaccctggcacttactgacacccccagcccctgcactgagcccacccacaaaacaccatggcccacgctgaaacccctctgcacaggcactcccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccatggggccctgaggtccgtgaatgcatgtgtcttccttgacccactccatgtctatatgtcaccttcccctggccctgcctccccacgtctcccccttgtgtctcccttctccctcacctgctgcttcccctcacaagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441743 - DNA, 1867 bp, Homo sapiens
  misc_feature (1734)..(1734): n is a, c, g, or t
  misc_feature (1736)..(1736): n is a, c, g, or t
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgccagcgtggccacctcantntcttctccaagtgctatgcacgcctcaacccggacgtcaccggccgcaaatcttttttggccacccagcaacctgcgtcccaagaagcaggtcaaataaggtggttctttccttgaagggcagcctcctgc

SEQ ID NO: 441744 - DNA, 1865 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaaggtaaaagaagcctttataagtaggtccacacctgccgtgattatcagtctgtcctgtaccttctcatcccattttatttgccaccaataaactagggttgggccacctaggaccctaccaactccccaactctgtgggccatgtctacaattcaagtaattgtagctgcccacggcgcaacaactccagtgcttctcaaacttcagcatgcatgagaatcactgggagagttttaaaaac

SEQ ID NO: 441745 - DNA, 1847 bp, Homo sapiens
  misc_feature (1827)..(1827): n is a, c, g, or t
  misc_feature (1833)..(1833): n is a, c, g, or t
  misc_feature (1837)..(1837): n is a, c, g, or t
  misc_feature (1841)..(1841): n is a, c, g, or t
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaaaaaaaaaaaaaaaaaaaagaaaaaaaaaaaaaagaaaaaaaaaanaaaaangaanaatnaaaaca

SEQ ID NO: 441746 - DNA, 1743 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggggctgggtgttcaacggaggcaagatgaccaggagcctacggggtacaatggagaaatgaaggatctgtggtagcgctgtactgatggcgtgtgtgtgtccccaaaagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441747 - DNA, 2191 bp, Homo sapiens
cggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagagagcacctctatcgccaccacggagcactggttcactcctgacaccctggcacttactgacacccccagcccctgcactgagcccacccacaaaacaccatggcccacgctgaaacccctctgcacaggcactcccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccatggggccctgaggtccgtgaatgcatgtgtcttccttgacccactccatgtctatatgtcaccttcccctggccctgcctccccacgtctcccccttgtgtctcccttctccctcacctgctgcttcccctcacaagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441748 - DNA, 1197 bp, Homo sapiens
ggagtagggtagcatgagtggtaaagaagagaggagtaagttaattatgccttattgggttgaggtgatgatggaggtggagatttggtgctgtgaaattgttttaggtaatagcttttctagtcaggttaggtctaaggaaggaggtaagggcaaggtttgggagcggagcgcctggctacagccctgcagaagctggaggaggccgagaaggcggctgatgagagcgagagaggaatgaaggtcatcgaaaaccgggccatgaaggatgaggagaagatggaactgcaggagatgcagagagcacctctatcgccaccacggagcactggttcactcctgacaccctggcacttactgacacccccagcccctgcactgagcccacccacaaaacaccatggcccacgctgaaacccctctgcacaggcactcccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccatggggccctgaggtccgtgaatgcatgtgtcttccttgacccactccatgtctatatgtcaccttcccctggccctgcctccccacgtctcccccttgtgtctcccttctccctcacctgctgcttcccctcacaagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 441749 - DNA, 6301 bp, Homo sapiens
  misc_feature (304)..(304): n is a, c, g, or t
  misc_feature (309)..(309): n is a, c, g, or t
acttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagattacaaagaagagattattcatagattataaagcttggaaagaatcaaaacaacacatttctggaaacagattgtataaatgctacaaaagagaaaaatatattttctccccacgcaacacaagaccttaaagncaatnctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441750 - DNA, 5360 bp, Homo sapiens
tgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441751 - DNA, 5387 bp, Homo sapiens
tccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcaggtgagcgcgcgcgacgcgggcgtgccgcctctgggcagcaacgtgacgctgcaggtgttcgtgctggacgagaacgacaacgcgccggcgctgctggcgcctcgggtgggtggtactggtggtgcagtgagcgagctggtgccgcggtcactgggtgcaggccaagtggtggcgaaggtgcgcgcagttgacgccgactcaggctacaacgcgtggctttcgtatgagctgcagcccccggcaagcagcgctcgcttcccgtttcgcgtggggctgtacacgggcgagatcagcaccactcgtgtcctggacgaagcggactctccgcgccaccggctgctggtgctggtgaaagaccacggtgagccggcgctgacagcgacggccacggttctggtgtcgctggtggagagtggccaggctccaaaggcgtcatcacgggcgtcggtgggcgccgcgggcccagaggcggcgctggtggatgtcaacgtgtacctgatcatcgccatctgcgcggtatccagcctgctggtcctcacgctactgctgtacacagcgctgcggtgctcggcgccacccaccgagggcgcgtgcacggcggacaagcccacgctggtgtgctccagcgcagtggggagctggtcgtactcgcagcagaggcggcagagggtgtgctccggggagggcccacccaagatggatctcatggcctttagccccagcctttcaccttgtcctattatgatgggtaaggcggagaatcaggatttaaatgaagatcatgatgccaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441752 - DNA, 5229 bp, Homo sapiens
atggtgtgcccgaatggatacgacccagggggccgacatctactgctgtttattataattctagcagcttgggaggcagggagaggccagctccactactcggtccccgaggaggctaaacatggcaacttcgtgggccgcatcgcgcaggacctggggctggagctggcggagctggtgccgcgcctgttccgggcggtgtgcaaattccgtggggatcttctggaggtaaatctgcagaatggcattttgtttgtgaattctcggatcgaccgcgaggagctgtgcgggcggagcgcggagtgcagcatccacctggaggtgatcgtggaaaggccgctgcaggttttccatgtggacgtggaggtgaaggacattaacgacaaccctccggtgttcccagcgacacaaaggaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactctcacttccctgtctctccctattccagaggacgcccaaccaggtaccgtcatcacattgattagcgtgtttgaccgagattttggagtcaacggacaggttacctgctccctgacgccccgcgttcccttcaagttggtgtccaccttcaagaattactattcattggtgctggacagcgctctggaccgcgagagtgtgtccgcctatgagctggtggttaccgcgcgggacgggggctcgccttctctgtgggccactgctagcgtgtccgtggaggtggccgacgtgaacgacaacgccccggcgttcgcgcagcccgagtatacggtgttcgtgaaggagaacaacccgccgggctgccacatcttcactgtgtcggcgggggacgcggacgcgcagaagaacgcgctggtgtcctactcgctggtggagctgcgggtgggcgagcgcgcgctgtcgagctacgtgtcagtgcacgcggagagcggcaaggtgtacgcgctgcagccgttggaccacgaggagctggagctgttgcagttccaggtgagcgcgcgcgatgcgggcgtgccgcctctgggcagcaacgtgacgctgcaggtgttcgtgctggacgagaacgacaacgcgccggcactgctggcgcctcgggtgggtggcactggtggcgcagtgagagagcttgtgccgcggtctgtgggcgcgggccatgtggtggcgaaggtacgtgcagttgacgctgactcaggctacaacgcgtggctttcgtatgagttgcaaccggtggcggccggtgcgagcatcccgttccgcgtggggctgtacactggtgagatcagcacgacacgagccctagatgagacggacgcaccgcgccaccgccttctggtgcttgtgaaggaccacggggagccctcgctgacagccacagccaccgtgctggtgtcgctggtggaaagcggccaggcaccaaaggcgtcgtcgcgggcatcgttgggcattgcaggcccagagaccgagctggtggatgtcaacgtgtacctgatcatcgccatctgcgcggtgtccagtctgttggtgcttaccctgctgctgtacacggcgttgcggtgctcagcgccgtcctctgagggcgcatgtagtttggtaaagcccactctggtgtgctccagcgcggtggggagctggtcattctcccagcagaggcggcagagggtgtgctctggggagggcccacccaagacagacctcatggccttcagtcccagccttcctcagggtccatcctctacagacaatccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441753 - DNA, 5268 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441754 - DNA, 5368 bp, Homo sapiens
gaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441755 - DNA, 5268 bp, Homo sapiens
atgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441756 - DNA, 6706 bp, Homo sapiens
  misc_feature (304)..(304): n is a, c, g, or t
  misc_feature (309)..(309): n is a, c, g, or t
acttggacgttggaataagatagtaaaactcacaacaaaactttgtagaacttagtcaggaaaagaatctcaagcatagctttaaaaacagaaattgccccgagtactaaggatgagcaataatgaaattaaaacatattgtaataacattacacaaactatattggagattacaaagaagagattattcatagattataaagcttggaaagaatcaaaacaacacatttctggaaacagattgtataaatgctacaaaagagaaaaatatattttctccccacgcaacacaagaccttaaagncaatnctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacagttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagacattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttatttttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttgggaggccaaggtgggagggtcccttccttgagcccagcagtttgagaccaatgtagtgagactcatctctgccaaaaaaaaaaaattagccgggcatggtggcacacatctctagtcccaattactcaggaggctgaggcgagagaatcgcttgagcctgggacattgaggctgcagtgaactgtgatggcacaactgcatttcagcccgggtgacagcaagattctgtctcaaaaaaaa

SEQ ID NO: 441757 - DNA, 4476 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441758 - DNA, 4473 bp, Homo sapiens
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441759 - DNA, 3291 bp, Homo sapiens
ttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacaggtgagttttctacagattccacctatcaggaagtgtatgtga

SEQ ID NO: 441760 - DNA, 2571 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatgtaagtccaactttcgagttttggctttaaatatttttcatatttaacttgtctaatcatcttttcaaatatcactttaaaaaatgtcttcaaggtgttcactaacgttgaaataaatcataccattgaatgtagatatcctattaatggcagttttgtcttgaatggaactagaaa

SEQ ID NO: 441761 - DNA, 2427 bp, Homo sapiens
atgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaa

SEQ ID NO: 441762 - DNA, 2475 bp, Homo sapiens
atgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaa

SEQ ID NO: 441763 - DNA, 2655 bp, Homo sapiens
atggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaa

SEQ ID NO: 441764 - DNA, 3269 bp, Homo sapiens
ccagagtaaaaaagggtaaaaaggtaatatattttagggcttaaaatagttatttttttccaagatgaaagctatgagtaaacttaaaccagaaaatcgactagttttaaatctacagaataaacagtagagccttccttttagccacatgatgtcgctgtccaccatagagtgttctctaggaaggaaaatacccagagcccctttgttacttcagagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaag

SEQ ID NO: 441765 - DNA, 5369 bp, Homo sapiens
atgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441766 - DNA, 6123 bp, Homo sapiens
ttttcctttgtggattcttttttaaaactaccaagtttgagaatatgaatatatttgtttttcatattgttctgcaatgaatataaagtcacttataatcagaaagcaattaaatgtaaataacagtaaagaatgagaactatagaaaatagatatgaaaatgcaagcccacagagatgagaatagatcatgtggaacataaacactaaagagctgcttttataaaacttcaattttttctttgagttccctagcagccaaagtaacaagggagactgaaagtaaaacaattcaaatttgatagtatttttatatgaggaacaacactttcaggaaatgtttaaccctagtttttcatgaggccaccttaacaactgaattctctttctctctcactctgtgtataagtattttagataagtaaaagaacaatgttataatgttaagtcaaacatagacacaataatttaaatttgatgttaatcgagaaatacaatgccatttccatatatatttagtttcaatatgacttataatctgaatattccataaataagcacgttggaaatatttgggggaagaaacccaaaacacgtgaaattctgtggtggtaaatgcagtgcacagtactcacagttttaggcgcaaggtgtcgctctttacttggtggaaagttcatttaaaggttggtctgaacagtgaggcactcccatacaaaggaactccatcataccggatgccaccgtttaaggatcctttgaaacttcttaagaattcaacgagatttttaacctgaaactgaagaatctggtactgtaagtgtaaagaagcttattttggaagccaatttcgtatgcgatgtttggttttcagagaaggggattgggcaccccacgactacagctctggcttctcctcctcgaattctgggaggtggggagcggccagctccactactccgtctcggaggaggccaaacacggcaccttcgtgggccgcatcgcgcaggacctggggctggagctggcggagctggtgcagcgcctgttccgggtggcgtccaaaacacatggggaccttctggaggtaaatctgcagaatggcattttgtttgtgaattctcggatcgaccgcgaggagctgtgcgggcagagcgcggagtgcagcatccacctggaggtgatcgtggacaggccgctgcaggttttccatgtgaacgtggaggtgaaggacattaacgacaacccgccggtgttctcgctcagagaacaaaagctgctgattgcggaatctaagcaatcggactcgcgttttccactagagggagcttctgatgctgacattgaagagaatgctctattgacctacaggctaagtaaaaatgagtatttttctttagattcaccaacaaatggtaagcagattaaaagactgtcacttattttaaagaagtctctggatagagagaaaactccggaacttaatttgctgctaacagctacagacgggggaaaaccagagcttactggcaccgttcggctgttagtccaagtcttggatgtcaacgacaatgatccagagtttgataaatcagaatataaggtgagccttatggaaaatgctgctaaagaaactcttgtgctcaaactaaacgccacagaccgagacgaaggagtcaatggagaggtaacatactccttaatgtcaattaagcccaatggaagacacttatttacactagatcaaaataatggagaagtgagggtcaatggaactttagattatgaagaaaacaagttttataaaattgaagtacaggctacagataaggggactcccccaatggcaggtcactgtacagtctgggtggaaatcttggacaccaacgataactctcctgaagtcgccgtgacttccttgtccctcccagtacgagaggacgctcagcccagcacggtcattgccctgatcagcgtgtctgaccgtgactcaggtgtcaacggacaggtgacctgctcgctgacgccccacgttcccttcaagctggtgtccaccttcaagaattactactcgttggtgctggacagcgccctggaccgcgagaacgtgtgggcctatgaactggtggtgactgcgcgggatgggggttcgccttctctgtgggccacggccagggtatccgtggaggtggccgacgtgaacgacaatgcgcctgcgttcgcacagcccgagtacaccgtgttcgtgaaggagaacaacccaccaggctgccacatcttcacagtgtcggcgcgggacgcggacgcgcaggagaacgcgctggtgtcctactcgctggtggagcggcggttgggcgaccgcgcgctgtcgagctacgtgtcggtgcacgcggagagcggcaaggtgtacgcgctgcagccgttggaccacgaggagctggagctgctacagttccaggtgagcgcgcgcgatgcgggcgtgccgcctctgagcagcaacgtgacgctgcaggtgttcgtgctggacgagaacgacaacgcgccggcactgctggcgactcaggctggcagcgcgggaggcgcagttaacaagctagtaccgcggtcggtgggtgcgggccacgtggtggcgaaggtgcgcgcagtggatgcggactcaggctacaacgcgtggctttcatatgaattgcagccggcggcgggcggctcgcgcatcccgttccgcgtggggctgtacacgggcgagataagcacaacgcgtgccctggacgaggcagactcgccgcgccaccgacttctagtactggtgaaggatcacggtgagccggcgctgacggccacggccaccgtgctggtgtcgttggtggagagcggacaggcgccaaaggcctcttcccggactttggcgggcgccgcgagcccagaggctgcgctggtggatgtcaacgtgtacctgatcatcgccatctgcgtggtgtccagcctcctggtactcacgctgctgctgtatacggcgctgtggtggtcggcaacgcccactgagggcgcgtgcgcgccggggaagcccacgctggtgtgctcccgcgcggtggggagctggtcatactcgcagcagaggcggcagagggtgtgctctgaggagggcccacctaagacggacctcatggccttcagccccagtcttcctctaggtctgaataaagaggaggaaggggaaagacaggagccagggtcaaatcaccccggacagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441767 - DNA, 5262 bp, Homo sapiens
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441768 - DNA, 5268 bp, Homo sapiens
atgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441769 - DNA, 5268 bp, Homo sapiens
atggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441770 - DNA, 4595 bp, Homo sapiens
tccctgactgttgaatgatggcggacgcagaagaaatggattaataaattccggaacatacagtattttatctttatgcggaagatcttctaatggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441771 - DNA, 5439 bp, Homo sapiens
atggagcaggcgggcaccagacctgcggcgacagagcatccacggctccggcggcccatgccctggctgctgctactgcctctcctgctgctgttgctgctgctgctacctggccctgcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcatcccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441772 - DNA, 2535 bp, Homo sapiens
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaaggtgggttattacgttttcattttccttttgtgctttatgaataatattttctcttaccgcattttctcaaatatgtatcagaatatttcatttttgtctacattccatttatgcttgaatatttctagtgatacctttgtaatataa

SEQ ID NO: 441773 - DNA, 2593 bp, Homo sapiens
gaaaagaaccttccatttttggctgtgccaagaagctcagaaaggcgataatataaaaaatatatagttaattgggaattgaatttacaaaatacattgtgtggtgatgcaatagaaagctcataattggaacgagattgagatggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttag

SEQ ID NO: 441774 - DNA, 2445 bp, Homo sapiens
atggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtag

SEQ ID NO: 441775 - DNA, 5585 bp, Homo sapiens
ccagagtaaaaaagggtaaaaaggtaatatattttagggcttaaaatagttatttttttccaagatgaaagctatgagtaaacttaaaccagaaaatcgactagttttaaatctacagaataaacagtagagccttccttttagccacatgatgtcgctgtccaccatagagtgttctctaggaaggaaaatacccagagcccctttgttacttcagagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatgaaaaaaaa

SEQ ID NO: 441776 - DNA, 2836 bp, Homo sapiens
ccagagtaaaaaagggtaaaaaggtaatatattttagggcttaaaatagttatttttttccaagatgaaagctatgagtaaacttaaaccagaaaatcgactagttttaaatctacagaataaacagtagagccttccttttagccacatgatgtcgctgtccaccatagagtgttctctaggaaggaaaatacccagagcccctttgttacttcagagaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgatttt

SEQ ID NO: 441777 - DNA, 5012 bp, Homo sapiens
  misc_feature (19)..(19): n is a, c, g, or t
  misc_feature (2971)..(2971): n is a, c, g, or t
  misc_feature (2982)..(2982): n is a, c, g, or t
  misc_feature (2990)..(2990): n is a, c, g, or t
  misc_feature (3018)..(3018): n is a, c, g, or t
  misc_feature (3179)..(3179): n is a, c, g, or t
  misc_feature (3257)..(3257): n is a, c, g, or t
  misc_feature (3382)..(3382): n is a, c, g, or t
  misc_feature (3384)..(3384): n is a, c, g, or t
  misc_feature (3396)..(3396): n is a, c, g, or t
  misc_feature (3422)..(3422): n is a, c, g, or t
  misc_feature (4618)..(4618): n is a, c, g, or t
  misc_feature (4671)..(4671): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaaantcaggccgggnatggtggntcacgcctgtaatcccagcactttgggnggtcgaggtgggcagatcacctgaggtcaggagttcgagaccagcctggccaacatggtaaaaccccatttctactaaaaaatacaagaattagctgggtgtggtggcgcatgcctgtaatcctagctactcaggaggctgaggcaggagaatcacttgancccaggaggcgaagattgcagtgagctgatatcgcaccattgtactccagcctgtgtgacagagcaatactcttgtcncaaaaaaaaaaaaaattcaaatcagagtgaagtgaatgagacactccagttttccttctactccgaattttagctcctcctttcaacattcaacaaatagtcttttttttttttttttttttttngngatggagtctcnctctgttgcccaggctggagtgcagnggtgcgatctctgctcactacaagctctgcctcccgagttcaagtgattctcctggctcaccctcctgagctgggattacaggcgcctgccaccatgcctggctaattttgtgtttttagtggagacggggtttcaccatgttgtccaggatggtcttgatctcctgaccttgtgatccacccacctcagcctcccaaagtgctgggattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441778 - DNA, 773 bp, Homo sapiens
cccacgtgtattttcccctcaaagaaaagctgcatccttaacaccccatctgttcagtcctcatgactccagtgggccagttctgcgtagtccctgccctcgtggagaacacattcctcctggggagactgacagatgcaaagacaggaacaagccagggtcatgttggcgccggaagagccgaccgtgtgtggcgtgggaaattgacttacctgcctgctgggagatggaggggttgcggttgtgtggtttcagttaaggagcacttcccggagaaggaagagagcaggatggagtaggaactagccaaccctaggtaagaggttctagacatgcgtgcgttgagacctggagtcttgggagaggatgcttaaaaggtgattttacccctaggaatatgggggcactgaaatttttttttttttttgagacgggagtcttgctctgcaagctggagtgcagtggcccacgctagaatgcagtggcgcgattgcggctcattgcaacatctgccacctggggtcaagtggttctcttgcctcagcctcccgaggagcggggattacaggcgtgcgccaccactcctggctaattttttttttagtagagacgggggtttcgtcattttggccaggctggtctcgaactcctgacctcagatgatccacccgccttggcctcccaaagtgctgagattacaggtgtaagccactgcgcccagccctttgaaagtttttcagtatttatgtatatatatttttgagttggagtct

SEQ ID NO: 441779 - DNA, 4351 bp, Homo sapiens
  misc_feature (19)..(19): n is a, c, g, or t
  misc_feature (3957)..(3957): n is a, c, g, or t
  misc_feature (4010)..(4010): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441780 - DNA, 4200 bp, Homo sapiens
  misc_feature (19)..(19): n is a, c, g, or t
  misc_feature (3806)..(3806): n is a, c, g, or t
  misc_feature (3859)..(3859): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441781 - DNA, 4705 bp, Homo sapiens
  misc_feature (19)..(19): n is a, c, g, or t
  misc_feature (2971)..(2971): n is a, c, g, or t
  misc_feature (2982)..(2982): n is a, c, g, or t
  misc_feature (2990)..(2990): n is a, c, g, or t
  misc_feature (3018)..(3018): n is a, c, g, or t
  misc_feature (3179)..(3179): n is a, c, g, or t
  misc_feature (3257)..(3257): n is a, c, g, or t
  misc_feature (3382)..(3382): n is a, c, g, or t
  misc_feature (3384)..(3384): n is a, c, g, or t
  misc_feature (3396)..(3396): n is a, c, g, or t
  misc_feature (3422)..(3422): n is a, c, g, or t
  misc_feature (4311)..(4311): n is a, c, g, or t
  misc_feature (4364)..(4364): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaaantcaggccgggnatggtggntcacgcctgtaatcccagcactttgggnggtcgaggtgggcagatcacctgaggtcaggagttcgagaccagcctggccaacatggtaaaaccccatttctactaaaaaatacaagaattagctgggtgtggtggcgcatgcctgtaatcctagctactcaggaggctgaggcaggagaatcacttgancccaggaggcgaagattgcagtgagctgatatcgcaccattgtactccagcctgtgtgacagagcaatactcttgtcncaaaaaaaaaaaaaattcaaatcagagtgaagtgaatgagacactccagttttccttctactccgaattttagctcctcctttcaacattcaacaaatagtcttttttttttttttttttttttngngatggagtctcnctctgttgcccaggctggagtgcagnggtgcgatctctgctcactacaagctctgcctcccgagttcaagtgattctcctggctcaccctcctgagctgggattacaggcgcctgccaccatgcctggctaattttgtgtttttagtggagacggggtttcaccatgttgtccaggatggtcttgatctcctgaccttgtgatccacccacctcagcctcccaaagtgctgggattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacgaggtcaggaaatcgagaccatcctggctaacacgggtgaaaccccgtctctattaaaaaatagaaaaaattaggcgggcgtggtggtgagcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441782 - DNA, 3029 bp, Homo sapiens
  misc_feature (19)..(19): n is a, c, g, or t
  misc_feature (2979)..(2979): n is a, c, g, or t
  misc_feature (2981)..(2981): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaacgatatcccgngnttccgaccgtaccagcctgcttaataaccgactttctatattcacatg

SEQ ID NO: 441783 - DNA, 4283 bp, Homo sapiens
  misc_feature (19)..(19): n is a, c, g, or t
  misc_feature (3889)..(3889): n is a, c, g, or t
  misc_feature (3942)..(3942): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaatatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441784 - DNA, 4228 bp, Homo sapiens
  misc_feature (19)..(19): n is a, c, g, or t
  misc_feature (3834)..(3834): n is a, c, g, or t
  misc_feature (3887)..(3887): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441785 - DNA, 3959 bp, Homo sapiens
  misc_feature (3565)..(3565): n is a, c, g, or t
  misc_feature (3618)..(3618): n is a, c, g, or t
cttcggcctagaattgccagtgtcgcttcatccacattcagttagttaaagcaatcacaagcccagcccatttcaaggtgaaattactacagaggcatgaacaccatgaggtgtccatagggggccatcagcataacacactgccacatacatgcactcactttttttctttaacctaaagtgagatccatcagtagtacaggtagttgttggcaaagcctcttgttcgttccttgtactgagaccctagtctgccactgaggatttggtttttgcccttccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441786 - DNA, 2526 bp, Homo sapiens
  misc_feature (19)..(19): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcagatgcttcttgacgtcaagaagcatcctgagttagatgcataggattatagcagacataatcatgtgagaggccagagaaagaaattgacaggcaaaagcaagaaattgagtttgtgtttagggaacaatgagtggctctttttgcccttggcagtgggattcacatctaggagaagacagaggaggtggaggcaggaggatcatttgagcccaggaatgcaagaccagcctgggcaaaatggcaagaccctgtctttacagaaaattttttaaaaattagccagccatggtgcctgcacccggtcc

SEQ ID NO: 441787 - DNA, 2578 bp, Homo sapiens
  misc_feature (28)..(28): n is a, c, g, or t
  misc_feature (2184)..(2184): n is a, c, g, or t
  misc_feature (2237)..(2237): n is a, c, g, or t
tttctgcgacagagtgagacaccgtctnaaaaaaaaaaacaaaaaacaaaaattatccaggtgtggcggtgggcgctgtgaggcaggcgaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441788 - DNA, 3296 bp, Homo sapiens
  misc_feature (19)..(19): n is a, c, g, or t
  misc_feature (2902)..(2902): n is a, c, g, or t
  misc_feature (2955)..(2955): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacagattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441789 - DNA, 2543 bp, Homo sapiens
  misc_feature (2149)..(2149): n is a, c, g, or t
  misc_feature (2202)..(2202): n is a, c, g, or t
tcgatgccactgtctctctcatactcatgtctctgatatcatgatgtgtgtgtgtgttactctcgtctctctgcctctatctctctcaatctctctttctctgtgtctgtctgtgtttgtttctgatcctctatctcttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441790 - DNA, 2607 bp, Homo sapiens
  misc_feature (19)..(19): n is a, c, g, or t
  misc_feature (2213)..(2213): n is a, c, g, or t
  misc_feature (2266)..(2266): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcgcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441791 - DNA, 2407 bp, Homo sapiens
  misc_feature (2013)..(2013): n is a, c, g, or t
  misc_feature (2066)..(2066): n is a, c, g, or t
aaacctgcaggccgagcacagtggctcatgcctgtaatcccagcattttgggagacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441792 - DNA, 2484 bp, Homo sapiens
  misc_feature (2090)..(2090): n is a, c, g, or t
  misc_feature (2143)..(2143): n is a, c, g, or t
gaggcttaggtgggaggatcccttgagcccaggagtttgaggctgcagtgagccatgatcataccactgcactccagcccaggtgacagagtgagatcctgtctcaaaaaaagaaaaaaaaaaaaaatcaggccgggcatggtggctcacgcctgtcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441793 - DNA, 2166 bp, Homo sapiens
  misc_feature (1772)..(1772): n is a, c, g, or t
  misc_feature (1825)..(1825): n is a, c, g, or t
ggtgagacttctccgccgcctccgccgcagacgccgccgggcggcgcgtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcattgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441794 - DNA, 1157 bp, Homo sapiens
  misc_feature (19)..(19): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtctgcactccaacctgtcgacagtctaa

SEQ ID NO: 441795 - DNA, 606 bp, Homo sapiens
  misc_feature (19)..(19): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtacgggcccggcgcttaggcccgacccagcagggacgatagcacggtctgaa

SEQ ID NO: 441796 - DNA, 4178 bp, Homo sapiens
  misc_feature (19)..(19): n is a, c, g, or t
  misc_feature (3784)..(3784): n is a, c, g, or t
  misc_feature (3837)..(3837): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441797 - DNA, 4878 bp, Homo sapiens
  misc_feature (19)..(19): n is a, c, g, or t
  misc_feature (2971)..(2971): n is a, c, g, or t
  misc_feature (2982)..(2982): n is a, c, g, or t
  misc_feature (2990)..(2990): n is a, c, g, or t
  misc_feature (3018)..(3018): n is a, c, g, or t
  misc_feature (3179)..(3179): n is a, c, g, or t
  misc_feature (3257)..(3257): n is a, c, g, or t
  misc_feature (3382)..(3382): n is a, c, g, or t
  misc_feature (3384)..(3384): n is a, c, g, or t
  misc_feature (3396)..(3396): n is a, c, g, or t
  misc_feature (3422)..(3422): n is a, c, g, or t
  misc_feature (4484)..(4484): n is a, c, g, or t
  misc_feature (4537)..(4537): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaaantcaggccgggnatggtggntcacgcctgtaatcccagcactttgggnggtcgaggtgggcagatcacctgaggtcaggagttcgagaccagcctggccaacatggtaaaaccccatttctactaaaaaatacaagaattagctgggtgtggtggcgcatgcctgtaatcctagctactcaggaggctgaggcaggagaatcacttgancccaggaggcgaagattgcagtgagctgatatcgcaccattgtactccagcctgtgtgacagagcaatactcttgtcncaaaaaaaaaaaaaattcaaatcagagtgaagtgaatgagacactccagttttccttctactccgaattttagctcctcctttcaacattcaacaaatagtcttttttttttttttttttttttngngatggagtctcnctctgttgcccaggctggagtgcagnggtgcgatctctgctcactacaagctctgcctcccgagttcaagtgattctcctggctcaccctcctgagctgggattacaggcgcctgccaccatgcctggctaattttgtgtttttagtggagacggggtttcaccatgttgtccaggatggtcttgatctcctgaccttgtgatccacccacctcagcctcccaaagtgctgggattacaggtgtgagccaccgcgtccagccagctttattattttttttaagctgtctttgtgtcaaaatgatagttcatgctcctcttgttaaaacctgcaggccgagcacagtggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441798 - DNA, 3947 bp, Homo sapiens
  misc_feature (3553)..(3553): n is a, c, g, or t
  misc_feature (3606)..(3606): n is a, c, g, or t
ggtgagacttctccgccgcctccgccgcagacgccgccgggcggcgcgtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441799 - DNA, 4957 bp, Homo sapiens
  misc_feature (19)..(19): n is a, c, g, or t
  misc_feature (2916)..(2916): n is a, c, g, or t
  misc_feature (2927)..(2927): n is a, c, g, or t
  misc_feature (2935)..(2935): n is a, c, g, or t
  misc_feature (2963)..(2963): n is a, c, g, or t
  misc_feature (3124)..(3124): n is a, c, g, or t
  misc_feature (3202)..(3202): n is a, c, g, or t
  misc_feature (3327)..(3327): n is a, c, g, or t
  misc_feature (3329)..(3329): n is a, c, g, or t
  misc_feature (3341)..(3341): n is a, c, g, or t
  misc_feature (3367)..(3367): n is a, c, g, or t
  misc_feature (4563)..(4563): n is a, c, g, or t
  misc_feature (4616)..(4616): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcagaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaaantcaggccgggnatggtggntcacgcctgtaatcccagcactttgggnggtcgaggtgggcagatcacctgaggtcaggagttcgagaccagcctggccaacatggtaaaaccccatttctactaaaaaatacaagaattagctgggtgtggtggcgcatgcctgtaatcctagctactcaggaggctgaggcaggagaatcacttgancccaggaggcgaagattgcagtgagctgatatcgcaccattgtactccagcctgtgtgacagagcaatactcttgtcncaaaaaaaaaaaaaattcaaatcagagtgaagtgaatgagacactccagttttccttctactccgaattttagctcctcctttcaacattcaacaaatagtcttttttttttttttttttttttngngatggagtctcnctctgttgcccaggctggagtgcagnggtgcgatctctgctcactacaagctctgcctcccgagttcaagtgattctcctggctcaccctcctgagctgggattacaggcgcctgccaccatgcctggctaattttgtgtttttagtggagacggggtttcaccatgttgtccaggatggtcttgatctcctgaccttgtgatccacccacctcagcctcccaaagtgctgggattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441800 - DNA, 4339 bp, Homo sapiens
  misc_feature (19)..(19): n is a, c, g, or t
  misc_feature (3945)..(3945): n is a, c, g, or t
  misc_feature (3998)..(3998): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgagagtctcactgtgtcacccaggctggagtgcagtggcgtgtgatcttggctcactgcaacctctgcctctcgggttcaagcgattctcctgcttcagcagctgggactacagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggtgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441801 - DNA, 2575 bp, Homo sapiens
  misc_feature (19)..(19): n is a, c, g, or t
  misc_feature (2181)..(2181): n is a, c, g, or t
  misc_feature (2234)..(2234): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtctgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441802 - DNA, 3040 bp, Homo sapiens
  misc_feature (19)..(19): n is a, c, g, or t
  misc_feature (2646)..(2646): n is a, c, g, or t
  misc_feature (2699)..(2699): n is a, c, g, or t
cctcgcctccgttacaacngcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgagtcctcatgactccagtgggccagttctgcgtagtccctgccctcgtggagaacacattcctcctggggagactgacagatgcaaagacaggaacaagccagggtcatgttggcgccggaagagccgaccgtgtgtggcgtgggaaattgacttacctgcctgctgggagatggaggggttgcggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaacaaattacaggtgtgagccaccgcgtccagccagctttattattttttttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaataggcagggtgtgttgtgtggtgttttaactaggcgcttctctctcagagagttttgaaacctgtttacataaaggcccangatgggaaggagatccaaacataagccaccagcctcattccaagtctcttctntttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaa

SEQ ID NO: 441803 - DNA, 1211 bp, Homo sapiens
ggtgagacttctccgccgcctccgccgcagacgccgccgggcggcgcgtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaatgtcaatcctagtttagaaacagtaataaaaccgacggcgtgggtcgacgatat

SEQ ID NO: 441804 - DNA, 826 bp, Homo sapiens
gcctcaacctcctgggctcaagccatccttccagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggagatctctcttctattctctccttcctcttcttgttcttcatattctcctactcctctttcttcttctactactcgttttttctcttcttctcttatatgtacatcttctcactttcctctcctctatgtcccactcatcactctctatacttcatcttcttctactcttcacctcccttctatcttctccctttctcatttccattctcatccctctccctttctcc

SEQ ID NO: 441805 - DNA, 2484 bp, Homo sapiens
agcggactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaatcctt

SEQ ID NO: 441806 - DNA, 2619 bp, Homo sapiens
agcggactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagactattccaattcacctgaaaatgtaaatgtctttgctgcttcctgtaagaagatagaataaagacatgggtttgtcagcactagattttcttctggtggagaatccttagatacttcattgggtctgtgtgccagatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaatcctt

SEQ ID NO: 441807 - DNA, 1902 bp, Homo sapiens
agcggactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaatcctt

SEQ ID NO: 441808 - DNA, 1171 bp, Homo sapiens
agcggactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttgtatgtatatgctgtttaagaaactatggtttggtatttttaattttttttttttttcaagacagagtcttgctctgttgtccaggctggaatgcaatggtactatctcggctcactgcgacctctgcctccccagttcaagcgattctcctgcctcagcctcccaagtagccgggattacaggtgcccgccaccacacccggctaatttttgtatttttactagagacggggtttctccatgttggtcaggctggtc

SEQ ID NO: 441809 - DNA, 473 bp, Homo sapiens
tgatattttttctcttttactcaaattcttggcatttacttcatatggtgagagcttagcctgaatgggactttatcgtgcaataacttaagaaaatttgtcctttttgaaaaaaaaaaaatcagcttatgattgttttttcttttactaaaaggcagctggtcttcatccaactgctgagcagattgaaatgtttgcctaccatctccctgatgcaacactgtccaatctcattgtaagtggaaactccctttcacatctcccctaaaaatgttgatatgtcaggtgattactggttaacctcatgagcatgaatggatagtctgcctttgagaagttgctatttataaaatttattttacaagtgaaaattttttctcaaaatcttttgggactttagccctgaggaatttcctctcagtatttcaggtggggaaggatatgagggagtgattaaagcaagcctttatgga

SEQ ID NO: 441810 - DNA, 2600 bp, Homo sapiens
agcggactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaatccttaaaacaacaagcgaacacccaaaacacaaaacgggaccagacagacaacaagaataccaccccggaaggcacaatcccacacacaacataacgggggtccccacaaaaaaaatcgc

SEQ ID NO: 441811 - DNA, 2620 bp, Homo sapiens
gactccatgtccttctgccgtgcgctatgggtgggctcggctcccgggcggtgccgccgaggcgtgggcacaggcgtcagtgcgatgctgcatctgcccttactgctacccacacttagtggacccattctgctcgcggcggtttctcggaggccagatatacatgctccgttagccaaacgtgactcacgtcctgcatgcacatccgagctgcgctcacgaggatagtacctatagagcgagggatccttgtgttgtcagagccctcttgaacgtgtagaagagcttccagggtgccctaggagccagaacggacgaccgtcagggcgcacggatggcttaaccacccggtgccgtgctgtgcacgatatgacattggacagtatagacgaatagtgtactctaagcacgagaacagtatattacgacatgaaggaaacacgcaagagtatccatcacatagcctgcgtgtcgacttgaatatactgagaacttcgtattgcatcgattcttcgtatttgcgacctacagactttatcatagaaactattttaaataaattgactattatgtcagctactcaatcgctccatggaactgctggaacaattcacacttgcgtgtttagtcattgatatcggcttcgagtgcggctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaatcctt

SEQ ID NO: 441812 - DNA, 1106 bp, Homo sapiens
agcggactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggttggtggtcgtaatgctataaaacccgtgctttatgacatctgcgctgagatgcatttttatctgcttgccattgccaaccaaatagagtcacctagaacctttctttttgaca

SEQ ID NO: 441813 - DNA, 3724 bp, Homo sapiens
ttcccacttccgacccccattccccacctaagccttgggtgcttgtggcctctcctcttgtgcccatgtactgcccacccagatgcacctcggcttgccctcatgtccccatctccttgcccaggagcccctgagtgtgtccctccttggccctgtggccacaggggagctgttccctccacaaaggctgctcttctgctctgtgcctgggcctcacccccaaaccccacccccagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttattctgtacagatttgggcaggcccaaggtgcccgagtgatctgaggatttataatccaagccacaccaccctggttgttctctgggcttggagggtacagtgccagcagcttccttgcccaattgatgttggagctgtagacgtacgctcaggcgctcctgctgtcctgggggagagaaggttcgcccctccccgaggaagaaggcttctggtcaggacccccaccccaaggctggggactccaggctcctgctttactgtagctctttttcttccttgcactccttgatctttgggcttccgtgatgtcctcagggtccccccctccctgttgctatttttaatctctagtcccagtgcctggcagctctttggagctggctcacattttcccaaaaaaagttgatctctcccagtgggctgtaggcagggtcctccatgggtttccaacccccatcactggcaccaggatctcccacaggcactggtggtgtcatcacctgctggccccactacagcctgagtaggcctgagtggccgtggccaggctgagacctgtcaggccatactgacaagcagaggtcagagacactggtggggagctggcaatgaaaccctgtcctgggacatgggtttcatgttcttgtacacttcccctctgggatcaggtgaggggtccagacagctgaccagacagcttgacagctggtcaagacggtcacgggagctctaggtgggcacaaccaacccctctcctgggaggcccctgccccactggggataggagcctgtgtccctggtgctaagcactctcttcacttgggccattgttggtgggggctcctttccggccagaccacaaggccagaagcaataatggcacctcagcagttccagtatggataggggttcctgttttactagcttttacatctttttatttaaaacaaaacaacacaaaaaaacaatgtgcccccagatgtcagaatgaggcgactagggcaccatactcactttccagggctgggggaagggggacgcaggatcatcccctcccaaggagatctgtgggggtcccaccgtccatctggacttctcagcctgtttggctagaactcaggcctggagtctgggtctgccccctccccggctccttggggctctctggtctcaggccagctggcgatgggtggctagagtgatgaactcaagccctgtggccacagttctgggagccttcaaccctggctcatgctgccatagtctccacggtgcccttcacagagggcttggtagtggcagaatggccatgcccaggtgtgtgttgagaccattgacaactgctcgtgtacaggcaccccacagccccagagcatggggcacagcaggcatgcgagtgagaggatgaaggggaataaagtcagtacaactcgt

SEQ ID NO: 441814 - DNA, 266 bp, Homo sapiens
gctcccctccccccgggtctggcctccagccccggcattcgctctcctcctttcacagttctgggagccttcaaccctggctcatgctgccatagtctccacggtgcccttcacagagggcttggtagtggcagaatggccatgcccaggtgtgtgttgagaccattgacaactgctcgtgtacaggcaccccacagccccagagcatggggcacagcaggcatgcgagtgagaggatgaaggggaataaagtcagtacaactcgt

SEQ ID NO: 441815 - DNA, 4310 bp, Homo sapiens
gaagaggaaggtggtggcagtggacgggaggaggaggaggaggaagagggtggcagtcagggagaagaggaagaagaggaggaggacgggcacagtgagcaggaagaggaagaggaggaggaagaggaggaagggcctagtgagcaggatcaagagagctctgaggaggaggagggggaggagggggaggctgggggcaagcaggggccacggggaagccgaagcagccgggcagacccccctccccacagtcacatggccacacggtcccgggagaacgcccggcgccggggtacccctgaacctgaagaagctgggcggcggggtgggaagaggccaaagccaccccctggagtggcctctgcatcggcccgagggccgccagccactgatgggctgggggccaaggtgaagctggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttattctgtacagatttgggcaggcccaaggtgcccgagtgatctgaggatttataatccaagccacaccaccctggttgttctctgggcttggagggtacagtgccagcagcttccttgcccaattgatgttggagctgtagacgtacgctcaggcgctcctgctgtcctgggggagagaaggttcgcccctccccgaggaagaaggcttctggtcaggacccccaccccaaggctggggactccaggctcctgctttactgtagctctttttcttccttgcactccttgatctttgggcttccgtgatgtcctcagggtccccccctccctgttgctatttttaatctctagtcccagtgcctggcagctctttggagctggctcacattttcccaaaaaaagttgatctctcccagtgggctgtaggcagggtcctccatgggtttccaacccccatcactggcaccaggatctcccacaggcactggtggtgtcatcacctgctggccccactacagcctgagtaggcctgagtggccgtggccaggctgagacctgtcaggccatactgacaagcagaggtcagagacactggtggggagctggcaatgaaaccctgtcctgggacatgggtttcatgttcttgtacacttcccctctgggatcaggtgaggggtccagacagctgaccagacagcttgacagctggtcaagacggtcacgggagctctaggtgggcacaaccaacccctctcctgggaggcccctgccccactggggataggagcctgtgtccctggtgctaagcactctcttcacttgggccattgttggtgggggctcctttccggccagaccacaaggccagaagcaataatggcacctcagcagttccagtatggataggggttcctgttttactagcttttacatctttttatttaaaacaaaacaacacaaaaaaacaatgtgcccccagatgtcagaatgaggcgactagggcaccatactcactttccagggctgggggaagggggacgcaggatcatcccctccagcctgtttggctagaactcaggcctggagtctgggtctgccccctccccggctccttggggctctctggtctcaggccagctggcgatgggtggctagagtgatgaactcaagccctgtggccacagttctgggagccttcaaccctggctcatgctgccatagtctccacggtgcccttcacagagggcttggtagtggcagaatggccatgcccaggtgtgtgttgagaccattgacaactgctcgtgtacaggcaccccacagccccagagcatggggcacagcaggcatgcgagtgagaggatgaaggggaataaagtcagtacaactcgt

SEQ ID NO: 441816 - DNA, 3773 bp, Homo sapiens
gaagaggaaggtggtggcagtggacgggaggaggaggaggaggaagagggtggcagtcagggagaagaggaagaagaggaggaggacgggcacagtgagcaggaagaggaagaggaggaggaagaggaggaagggcctagtgagcaggatcaagagagctctgaggaggaggagggggaggagggggaggctgggggcaagcaggggccacggggaagccgaagcagccgggcagacccccctccccacagtcacatggccacacggtcccgggagaacgcccggcgccggggtacccctgaacctgaagaagctgggcggcggggtgggaagaggccaaagccaccccctggagtggcctctgcatcggcccgagggccgccagccactgatgggctgggggccaaggtgaagctggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttattctgtacagatttgggcaggcccaaggtgcccgagtgatctgaggatttataatccaagccacaccaccctggttgttctctgggcttggagggtacagtgccagcagcttccttgcccaattgatgttggagctgtagacgtacgctcaggcgctcctgctgtcctgggggagagaaggttcgcccctccccgaggaagaaggcttctggtcaggacccccaccccaaggctggggactccaggctcctgctttactgtagctctttttcttccttgcactccttgatctttgggcttccgtgatgtcctcagggtccccccctccctgttgctatttttaatctctagtcccagtgcctggcagctctttggagctggctcacattttcccaaaaaaagttgatctctcccagtgggctgtaggcagggtcctccatgggtttccaacccccatcactggcaccaggatctcccacaggcactggtggtgtcatcacctgctggccccactacagcagcctgtttggctagaactcaggcctggagtctgggtctgccccctccccggctccttggggctctctggtctcaggccagctggcgatgggtggctagagtgatgaactcaagccctgtggccacagttctgggagccttcaaccctggctcatgctgccatagtctccacggtgcccttcacagagggcttggtagtggcagaatggccatgcccaggtgtgtgttgagaccattgacaactgctcgtgtacaggcaccccacagccccagagcatggggcacagcaggcatgcgagtgagaggatgaaggggaataaagtcagtacaactcgt

SEQ ID NO: 441817 - DNA, 1038 bp, Homo sapiens
ggggggttggaaacccatggaggaccctgcctacagcccactgggagagatcaacccccatcactggcaccaggatctcccacaggcactggtggtgtcatcacctgctggccccactacagcctgagtaggcctgagtggccgtggccaggctgagacctgtcaggccatactgacaagcagaggtcagagacactggtggggagctggcaatgaaaccctgtcctgggacatgggtttcatgttcttgtacacttcccctctgggatcaggtgaggggtccagacagctgaccagacagcttgacagctggtcaagacggtcacgggagctctaggtgggcacaaccaacccctctcctgggaggcccctgccccactggggataggagcctgtgtccctggtgctaagcactctcttcacttgggccattgttggtgggggctcctttccggccagaccacaaggccagaagcaataatggcacctcagcagttccagtatggataggggttcctgttttactagcttttacatctttttatttaaaacaaaacaacacaaaaaaacaatgtgcccccagatgtcagaatgaggcgactagggcaccatactcactttccagggctgggggaagggggacgcaggatcatcccctcccaaggagatctgtgggggtcccaccgtccatctggacttctcagcctgtttggctagaactcaggcctggagtctgggtctgccccctccccggctccttggggctctctggtctcaggccagctggcgatgggtggctagagtgatgaactcaagccctgtggccacagttctgggagccttcaaccctggctcatgctgccatagtctccacggtgcccttcacagagggcttggtagtggcagaatggccatgcccaggtgtgtgttgagaccattgacaactgctcgtgtacaggcaccccacagccccagagcatggggcacagcaggcatgcgagtgagaggatgaaggggaataaagtcagtacaactcgt

SEQ ID NO: 441818 - DNA, 427 bp, Homo sapiens
tgtgtgtttgggggtgtttaaggagttttcatccccaaccttagaaacatcagagctggctggctgttggcatcaagggctctccagcatatttcaagtgggaaaactgaggccagacgggggcagtagcttgcccaagtccaagaccctggggactcaggacccagggcctcaagtcctcttattctgcagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttggtaagtctgggccactgggggatggagccagaggatagagatggaccagcttctggctggtggatgggaaagacttcacatccaagg

SEQ ID NO: 441819 - DNA, 4352 bp, Homo sapiens
gaagaggaaggtggtggcagtggacgggaggaggaggaggaggaagagggtggcagtcagggagaagaggaagaagaggaggaggacgggcacagtgagcaggaagaggaagaggaggaggaagaggaggaagggcctagtgagcaggatcaagagagctctgaggaggaggagggggaggagggggaggctgggggcaagcaggggccacggggaagccgaagcagccgggcagacccccctccccacagtcacatggccacacggtcccgggagaacgcccggcgccggggtacccctgaacctgaagaagctgggcggcggggtgggaagaggccaaagccaccccctggagtggcctctgcatcggcccgagggccgccagccactgatgggctgggggccaaggtgaagctggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttattctgtacagatttgggcaggcccaaggtgcccgagtgatctgaggatttataatccaagccacaccaccctggttgttctctgggcttggagggtacagtgccagcagcttccttgcccaattgatgttggagctgtagacgtacgctcaggcgctcctgctgtcctgggggagagaaggttcgcccctccccgaggaagaaggcttctggtcaggacccccaccccaaggctggggactccaggctcctgctttactgtagctctttttcttccttgcactccttgatctttgggcttccgtgatgtcctcagggtccccccctccctgttgctatttttaatctctagtcccagtgcctggcagctctttggagctggctcacattttcccaaaaaaagttgatctctcccagtgggctgtaggcagggtcctccatgggtttccaacccccatcactggcaccaggatctcccacaggcactggtggtgtcatcacctgctggccccactacagcctgagtaggcctgagtggccgtggccaggctgagacctgtcaggccatactgacaagcagaggtcagagacactggtggggagctggcaatgaaaccctgtcctgggacatgggtttcatgttcttgtacacttcccctctgggatcaggtgaggggtccagacagctgaccagacagcttgacagctggtcaagacggtcacgggagctctaggtgggcacaaccaacccctctcctgggaggcccctgccccactggggataggagcctgtgtccctggtgctaagcactctcttcacttgggccattgttggtgggggctcctttccggccagaccacaaggccagaagcaataatggcacctcagcagttccagtatggataggggttcctgttttactagcttttacatctttttatttaaaacaaaacaacacaaaaaaacaatgtgcccccagatgtcagaatgaggcgactagggcaccatactcactttccagggctgggggaagggggacgcaggatcatcccctcccaaggagatctgtgggggtcccaccgtccatctggacttctcagcctgtttggctagaactcaggcctggagtctgggtctgccccctccccggctccttggggctctctggtctcaggccagctggcgatgggtggctagagtgatgaactcaagccctgtggccacagttctgggagccttcaaccctggctcatgctgccatagtctccacggtgcccttcacagagggcttggtagtggcagaatggccatgcccaggtgtgtgttgagaccattgacaactgctcgtgtacaggcaccccacagccccagagcatggggcacagcaggcatgcgagtgagaggatgaaggggaataaagtcagtacaactcgt

SEQ ID NO: 441820 - DNA, 2925 bp, Homo sapiens
gaagaggaaggtggtggcagtggacgggaggaggaggaggaggaagagggtggcagtcagggagaagaggaagaagaggaggaggacgggcacagtgagcaggaagaggaagaggaggaggaagaggaggaagggcctagtgagcaggatcaagagagctctgaggaggaggagggggaggagggggaggctgggggcaagcaggggccacggggaagccgaagcagccgggcagacccccctccccacagtcacatggccacacggtcccgggagaacgcccggcgccggggtacccctgaacctgaagaagctgggcggcggggtgggaagaggccaaagccaccccctggagtggcctctgcatcggcccgagggccgccagccactgatgggctgggggccaaggtgaagctggaggagaagcagcaccatccatgccagaagtgcccacgagttttcaacaaccgctggtacctggagaaacacatgaatgtgacccacagccgcatgcagatctgcgaccagtgcggcaagcgcttcctgctggagagcgagctgctgctgcacaggcagacagactgcgagcgcaacatccagtgtgtgacatgtggcaaagctttcaagaagctttggtccctccatgagcataacaagattgtgcacggctacgcagagaagaagttctcatgcgagatctgtgagaagaagttctacaccatggcccacgtgcgtaagcacatggttgcccacaccaaggacatgcccttcacctgcgagacctgcggaaagtccttcaagcgcagcatgtccctcaaggtgcactcactgcagcactcaggggagaagccgttcagatgtgagaactgcaatgagcgcttccagtacaagtaccagctgcggtcacacatgagcatccacattggccacaagcagttcatgtgccaatggtgcggcaaggacttcaacatgaagcagtacttcgatgagcacatgaagacccacacaggagagaagccgtacatctgcgagatctgtggcaagagcttcaccagccggcccaacatgaagcggcaccggcgcacgcacacgggcgagaagccgtacccgtgcgacgtgtgtggccagcgcttccgcttctccaacatgctcaaggcccacaaggagaagtgcttccgcgtcagccacaccctggccggcgacggcgtccccgctgccccaggcctgcccccaacccagccccaggcgcacgcactgcccctgctcccggggctgccccagaccctgccgcccccgccccacctgccgcccccgcctccgctcttccccaccactgccagccccggcgggaggatgaacgccaacaactagctgccgagctgcacccgtgcacccgctggggcctggagtcagggcccactccaggagggacccactgccttcccggggagcacagtagtgcgggcctgggccctgctccacctccagaagtggctggatgtaccctgcctgaggccccgacgaggaggggtatgcaggctggcaggccccagagctggtggagggcatctcactcccaagtgccccccctttctgtgactccttgaagcctttacttttttttttttttggaagtgaaggaaaaagaaactatttacagcactcccctccaggtgaggggggtgctgggggtctgcagcagaaagaaaggggcctgggcagcaggtgtggccagtccctctgccaaggcctgtgccagaggggttggccagttggagcctgggtcagcctcagcagcctatccccatgtcctctatgcccctaatttgcttcctcatcttggagggtttggggagaagttggcgtgccacccccacaacccctgaggaggtgtagacccagtctgagagccgcaagcactgaggcagggcctgagactggacctgggtgagcgtggggggtggagggtggcgaggtgcggagactgcagaccagtgcttcactgtgtggagtggggcaggcaggggctggaccccagggacttgccttccccacccactctgctgccagcaggcccagggatccctgacctgcaccaggtggcaccaagggtcctgagtcctggagatgtccccagaagctgctgtgcctcacagcgctgtgagccagaccctccttgggcagacaggctgactggcagcaccagctttgggggcagagtcctaggatgaggcttgggcagtgctggtagggtttcaaggtgctattagtggggcaggggcagggcggctgctcacagagcaccccagttcctcaccagctactctggccatatatcccacaccagaaggaacaagtgtggctgtgtccatctctgctcccccaaaggcccgctctaggccttatcctccctctaggtcctgccacaacctgtccctggctggctccagcgtcctcgtccctcctgggcctgtgcaccggtgggtggggcgcccatagcactgccggtaaaggagcctgcatgttcaggcccctcgggggattggggggactggggaggcgcagcctagacccaattgcttgcccccatgaggctagcactaataggaaacccttttttgttgtcatttaatgtctttattcctgcctttaatatggggaggaaggttccataagctacatgtttcctagttaagctctttcctattgtgtttatacagttttgtttgttatactctttgcaccttaaacccccaccactccccgacactattgccttcccagcatggctggagtgggaagaggcttgggccccgggggaatggttagggggactgaacccctctgaccttatgaggcccatggcactggggcagggagctggggacattttaatcatcaataaacgaagcactttattctgta

SEQ ID NO: 441821 - DNA, 2506 bp, Homo sapiens
agcgggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 441822 - DNA, 626 bp, Homo sapiens
agcgggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgttcagcttccagctgcccccctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 441823 - DNA, 885 bp, Homo sapiens
gaccaggaagttcgccgacgacgcgcccgccctgggccaccggcgccggcccaagttcgccgggggggcccggaggaagcttgggggacgcgacgggggaacgcggaaaccccggggatctgcaggcgcgcccgggccgtgtgccttctctccgcgtgtccaaaccgtgtccccagccgcgcgccatgcgctctgggggcgtgcgcagcttcgcgctggagctggcgcggggcccgggcggcgcctaccgcggcggggagcggctgtgcggccgggtgctgctggaggcggcggcgccgctgcgggtgcgagcgctcgaggtgaaggcgcgcggcggggcggccacccactggttggagggtcgcagcgtgggcgtcaacgccgtatccagcgactacgcggccgcggagacctacctgcggcgtcggcagctgctgctccgagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgcgggcccctgcaccccgagcatccgccccgggtggcacgtccccgagcccaccaggccggccccgtctccccatccgtctagtccgctcgcgg

SEQ ID NO: 441824 - DNA, 2632 bp, Homo sapiens
agcgggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccaggtacggatggaggacccctgctccaacaccagttgtgtgcctcccaccacctggacggcggtacctccgtcagccctgggaccccagcgcaaccgctcagtcgcctcctttttctcctacctgcagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 441825 - DNA, 3448 bp, Homo sapiens
agcgggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggggcgaaatagaaatattgtcctatgaggagtggaggaaagaaaatataaaacacgacacaaccagttgttttatagaagagaaggggaggacaacaaaaggaggagaaaatattatattaatatacgcgaggaggagggacaagtaaaaaaacaagttagaggagaaacaagcgacgaccgcgcagacgcacgcacgacacataaggagggagaaccaagcaccacagcattcggggagtcggggacgagaccccaccagacgggcggaggaaggcccacacaccacgacgaagaagaagaaagatacagaccaggcgccaggaggacaaaaaactaaaaaaacaaacgcagggagcgagcacgaggagaggagcagacaacacccaccgcacaggtagaaggagggggcagggacggaaagaaggaaaaactcgcccaggcgggaggagagagacgcagcaaaacaaaacaccaaaaatttacacaccaggcgggggggacggaacaacatgaggacagagcgggaaggaggcacgacgacgaacgcaaccgagagacctcgagacgcgcaggggcacaaaccagccagaacgcggcacagcagcaccgacgagcgagagagagagcggagaccagaggagcgaggaggaggcgaaagagggaaggaggacggggaagagcggagagagcgatgacgagacgacgaacggcaggaacggaggcgggcgagagggaggcaaaaggaagagaggagcagggaagcgaagagaggaagagagaaggaccaagcagacgagcaagccggaagcgcagggaagaagacggacgagca

SEQ ID NO: 441826 - DNA, 2829 bp, Homo sapiens
agcgggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccaggtacggatggaggacccctgctccaacaccagttgtgtgcctcccaccacctggacggcggtacctccgtcagccctgggaccccagcgcaaccgctcagtcgcctcctttttctcctacctgcagataccggggagaccacgacgctgcctcctgggcgccatgagttcctgttcagcttccagctgcccccccccgtaagtcctctggggtgcagggttgccctaagcctgcagccccttccagattggtacctccaatactggatatctgggcacctctgagccccaagactctccccctgggaggcccccggagtgtctgtgtctccttctccctgcctgcttgtctctgtatcttgtcccctgaagtcccgtccctccaccctaggaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 441827 - DNA, 1288 bp, Homo sapiens
gaccaggaagttcgccgacgacgcgcccgccctgggccaccggcgccggcccaagttcgccgggggggcccggaggaagcttgggggacgcgacgggggaacgcggaaaccccggggatctgcaggcgcgcccgggccgtgtgccttctctccgcgtgtccaaaccgtgtccccagccgcgcgccatgcgctctgggggcgtgcgcagcttcgcgctggagctggcgcggggcccgggcggcgcctaccgcggcggggagcggctgtgcggccgggtgctgctggaggcggcggcgccgctgcgggtgcgagcgctcgaggtgaaggcgcgcggcggggcggccacccactggttggagggtcgcagcgtgggcgtcaacgccgtatccagcgactacgcggccgcggagacctacctgcggcgtcggcagctgctgctccgagataccggggagaccacgacgctgcctcctgggcgccatgagttcctgttcagcttccagctgcccccagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 441828 - DNA, 1404 bp, Homo sapiens
gaccaggaagttcgccgacgacgcgcccgccctgggccaccggcgccggcccaagttcgccgggggggcccggaggaagcttgggggacgcgacgggggaacgcggaaaccccggggatctgcaggcgcgcccgggccgtgtgccttctctccgcgtgtccaaaccgtgtccccagccgcgcgccatgcgctctgggggcgtgcgcagcttcgcgctggagctggcgcggggcccgggcggcgcctaccgcggcggggagcggctgtgcggccgggtgctgctggaggcggcggcgccgctgcgggtgcgagcgctcgaggtgaaggcgcgcggcggggcggccacccactggttggagggtcgcagcgtgggcgtcaacgccgtatccagcgactacgcggccgcggagacctacctgcggcgtcggcagctgctgctccgagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatccccaggcacgtacaagagcttgatgcttgacaagcatgcacacataggatgaatccggccaccaatatcacatatggacacccattatagcggaacccggtatacctacccaagacgatgggaaccaagccaaaagacacaagataacacaaggggcatgggaaccatggacagggagccatgggagcggcaccaattaggacgagacaagccgggaccatgacagggaataccctacaccgtgcacgataccgtcggaacgagagtgaacaaaccccgcaacacctatgacaggaagaggaagacccaacagagaaagccaacaaacacacacataaccagaataacaccgcagggaaccccggaacat

SEQ ID NO: 441829 - DNA, 752 bp, Homo sapiens
agcgggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccaggtacggatggaggacccctgctccaacaccagttgtgtgcctcccaccacctggacggcggtacctccgtcagccctgggaccccagcgcaaccgctcagtcgcctcctttttctcctacctgcagataccggggagaccacgacgctgcctcctgggcgccatgagttcctgttcagcttccagctgcccccctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 441830 - DNA, 2530 bp, Homo sapiens
gaccaggaagttcgccgacgacgcgcccgccctgggccaccggcgccggcccaagttcgccgggggggcccggaggaagcttgggggacgcgacgggggaacgcggaaaccccggggatctgcaggcgcgcccgggccgtgtgccttctctccgcgtgtccaaaccgtgtccccagccgcgcgccatgcgctctgggggcgtgcgcagcttcgcgctggagctggcgcggggcccgggcggcgcctaccgcggcggggagcggctgtgcggccgggtgctgctggaggcggcggcgccgctgcgggtgcgagcgctcgaggtgaaggcgcgcggcggggcggccacccactggttggagggtcgcagcgtgggcgtcaacgccgtatccagcgactacgcggccgcggagacctacctgcggcgtcggcagctgctgctccgagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgtggagaaagaa

SEQ ID NO: 441831 - DNA, 2538 bp, Homo sapiens
  misc_feature (2494)..(2494): n is a, c, g, or t
agcgggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagctgagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaacctttcaattggttgccttaattataaaaatgcccagcgnagaggtttaaagtctttctgtttcacataaggtgcaaccgtgcc

SEQ ID NO: 441832 - DNA, 1603 bp, Homo sapiens
agcgggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgttcagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcactgccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctggactggaggctgggggccttgccggagcggcctgaggctcctcctgagtactcggaggtggtagccgacactgaggaggcagccttggggcagagccccttcccgcttccgcaggaccccgacatgagccttgaaggcccgttcttcgcctacatccaagagttccgctaccgcccgccacccctgtactctgaggaggatccaaacccactcttgggggacatgaggccgcgctgcatgacttgctgaacggcacagggacccctcgaggaacaaggttgcacaccagctttcagccaccatgactgtggggggggggccgtggctgggggggcccccgcccacatttatcatccttcaatttgtttgtgcaacctcatttttcctggatgccaggcaagagctcagaagccaccagtgcaaatacaaaaggctgtcacactggcctttgccctcgctggcgggggctcctggctcggggg

SEQ ID NO: 441833 - DNA, 882 bp, Homo sapiens
aaaatagctaggtcgagcctgggtgtgaattggccgaggcagtggcgtgtggagcggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaaaataaaaaaaactctggggcgcacaatctgggcggcgggaagagggtttgactgc

SEQ ID NO: 441834 - DNA, 2179 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441835 - DNA, 2236 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441836 - DNA, 2089 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagtgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441837 - DNA, 1979 bp, Homo sapiens
accccagtggaagtggagaagtcaggcgccaccaacaagcctctcccagccaggactttgcttagactcgctcctcccggcagggcgcacctaggcgggtccatcgccagccggggagaggggtttgggcagggagggaacaggtgcgcggcgggacccgccctatctcaacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441838 - DNA, 1612 bp, Homo sapiens
ggatacttgatttcggcttgtggggacagtggtggacccagcatctgggctttatataaagggcagctttgttgccctgtaaacacacagaccatgggtggccacttcttccagtaagttagctggggagttggaagtttaggtaaaaccttttgattgacaaatgttggcgaattaccatgctgttaaatgaaacattgttctgccaccctggggctgtgggtgcctgcgtgcaccctctgaaaaatcacacaggaagtggggtggggtctctgtgaagctggtgtcccccagcctcagggatgctgcagaaatggaatgaggaccaacagggactcagatgtccaaggaagctctacagcggagaggacggcttgggaaggaggtccaggcccaggtccctccggaacccaatgggtatggggcagcctggctcctgcctcatcccccttctcctgttgattgtgtcctcacagtgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441839 - DNA, 1841 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgtgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcggggtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441840 - DNA, 1090 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggaccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441841 - DNA, 2075 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgggaggacctcaggggtggctgagctcttacctggttttcaggcggggcccatagaagactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441842 - DNA, 2032 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgtgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441843 - DNA, 1997 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441844 - DNA, 1912 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaatgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441845 - DNA, 2234 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaaaataaaaaaaactctggggcgcacaatctgggcggcgggaagagggtttgactgc

SEQ ID NO: 441846 - DNA, 2155 bp, Homo sapiens
ctcacccctaagcccagccctcggctcccacccttgtgtacctgggccgaaccattcaccggagcgcgcagcgggtggagtgtggctcggaggaccgcggcgggtcaagcacctttctcccccatatctgaaagcatgccctttgtccacgtcgtttacgctcattaaaacttccagaatgcaacaggacggacttggagtagggacaaggaacggaagtgggaaggggaggagcgtgcacccctcctggccttggtgcgcgccgcgccccctaaggtactttggaagggacgcgcgggccagacgcgcccagacggccgcgatggcgctgttggccggcgggctctccagagggctgggctcccacccggccgccgcaggccgggacgcggtcgtcttcgtgtggcttctgcttagcacctggtgcacagctcctgccagggccatccaggtgaccgtgtccaacccctaccacgtggtgatcctcttccagcctgtgaccctgccctgtacctaccagatgacctcgacccccacgcaacccatcgtcatctggaagtacaagtctttctgccgggaccgcatcgccgatgccttctccccggccagcgtcgacaaccagctcaatgcccagctggcagccgggaacccaggctacaacccctacgtcgagtgccaggacagcgtgcgcaccgtcagggtcgtggccaccaagcagggcaacgctgtgaccctgggagattactaccagggccggaggattaccatcaccggaaatgctgacctgacctttgaccagacggcgtggggggacagtggtgtgtattactgctccgtggtctcagcccaggacctccaggggaacaatgaggcctacgcagagctcatcgtccttgactggctcttcgtggttgtggtatgcctggctgccttcctcatcttcctcctcctgggcatctgctggtgccagtgctgcccgcacacttgctgctgctacgtcaggtgcccctgctgcccagacaagtgctgctgccccgaggccctgtatgccgccggcaaagcagccacctcaggtgttcccagcatttatgcccccagcacctatgcccacctgtctcccgccaagaccccacccccaccagctatgattcccatgggccctgcctacaacgggtaccctggaggataccctggagacgttgacaggagtagctcagctggtggccaaggctcctatgtacccctgcttcgggacacggacagcagtgtggcctctgaagtccgcagtggctacaggattcaggccagccagcaggacgactccatgcgggtcctgtactacatggagaaggagctggccaacttcgacccttctcgacctggcccccccagtggccgtgtggagcgggccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgataatggtgggaggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaagaacttggccctgagtcgggaaagtttagtcgtctgatctgacgttttctacgtagcttttgtatttttttttttaatttgaaggaacactgatgaagccctgccatacccctcccgagtctaataaaacgtataatcacaa

SEQ ID NO: 441847 - DNA, 501 bp, Homo sapiens
gacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaaggtgagggccgccctccctggcgtccagaccgtccctgggcccccagccggtccccgcggctcatacccttctttctttctcccttgcagaacttggccctgagtcgggaaagtttagtcgtctgatctgacgttttctacgtagcttttgtatttttttttttaatttgaaggaacactgatgaagccctgccatacccctcccgagtctaataaaacgtataatcac

SEQ ID NO: 441848 - DNA, 3106 bp, Homo sapiens
  misc_feature (548)..(548): n is a, c, g, or t
  misc_feature (902)..(902): n is a, c, g, or t
  misc_feature (1464)..(1464): n is a, c, g, or t
  misc_feature (1651)..(1651): n is a, c, g, or t
  misc_feature (2135)..(2135): n is a, c, g, or t
gagtaactagagcaacagttgttctccctcgctggagtggtgaataggagccgggaggaggggactgttagggtcgggctgcctcagtctccacagtaattaagaggaaattgagttggatacagcggacatgaggcctggaatgggtaccccaaacccatgcatcttaagtgtctgggtccccacgcccccttctgcctgccaggagtactctgtgcagccatcctgtaactgcttcagtccagagaaggatagcatccatccctccctccagctcgcctctctgctgaggctttctcctctccactcagcatttgcaacagcttctctcctggcacttgtctgggaatatcaagttaaaaattacaacacccaattttgataactttagttgagagaaacaacctctagtgaagactgataagtaacttattgcccgtagtcccatgttcctttgtctccaccaagaggaattaccagcccagcagttctgccctcactagagtcccgtccaggagcttgagaggagaggatttttagggctggantgcctcagtctgcacagtaataagttgagttagacacagtggacatgaggacctggactcagatatctgaagaatccttattatttttttgttggcttgttttgagacagagtcaccctgttgcccaggctggagtgcattggcgcaatcttggctcactgcaacctctgcctcccaggttcaagtgattcttcttcctcagcctcccaggtagctaggattacagacatgcgccaccacgctcagctatttttcgtatttttagtggagatggggtttcaccatgttggtcaggctggtcttgaacaccagcctcagcctccccaagtgctgggattacaggcatgagccacngtgcccggccaaaatccttaatgtttttgttttttggtttttttttttgagacagtcttgctctgtcacccaggctggagtgcagtggcacaatcttggctcactgcaagctccgcctccggggttcatgccattctcccgcctcagcctcccgagtagctgggactacaggcgcctgccaccacgcccggctgattttttgtattttttagtagaggcagggtttcaccgtgttaggatggtctcgatctcctgacctcgtgatccgcccgcctcggcctcccaaagtgctgggattacaggcgtgagccaccgcgcccgggctatccttaatgttgatattagtggttagcacatgttttggaggaggacttcacactttttaaactatgctccctcgtattttctataagcagtcttaaattctttctggaataaagcaagattgatcagtatttctcaaggaggattatttggcaggcagtagctactgctcagagaacttggtattgttacatgcatcctggaagtatctgtgcctatttctagacggcctcagacnacttttttctgagtcctggacccttgaatctgcagccaagcaagctcttgggtccctcccaagtctcatgtttagtaaagccctgtgagaataattttattggtggaggagtcaagatgatacttccctcacctgcatcagaggaaaccacatcagaaacaatccacctagaaaaacactgcatacnggaaagctgacaacttgccctgagaaatcacagctttggtgcaagaggtgaagccgaactggtaaaagatcaaagtgaattcagagatcaaactgtactagggaaaggagcagaggctgagatcttgctgccagcgtgacctctcacagagtggcccagcagaggctgtgcagagatggccagagccaggacccagccctgtggagcccctgggcacatgtggtcccgagtgaagccgtgcctgttgctctgaacaggtgggatcaatctgtaggtttttccacttttcacagagtgtggctctctttaggtctgcactccctctctgcgcagggcggacctccctgggctctgcagcatgatctcctgtcccaagacagtcgtgctcttggacagttagcttctgtcattaggaagtgcccacatgagctcttgtttattggaaaccgtgttctatgcctcctttggggtttctgcaactcantttggcaggtagcttagtggtccacttggtctcaaattccagctccaccatgtgcagttgtgtgttctttggcaagttcctcccctcctccgaatctgtcagtgggggaagagtgcatgtctcacagagttgaggtgagaaataagttaatgaatatgaaattctttgcccagcccctggcacgtggaagggctcagcaatcctgtatccgttgtagtggtcatcactctgtggctcttcactgcttttgttttgttttgggagggggtggagaacaatttgttctgtgtttgtgtggggcaaggcctgtcttcagggctctctccaaccacgtacgctctggctggagcttctgaaaggacacagttcttgcatagaagttgctttctccagcttgcccaccaggcagtctggcttcagacatctatgttgcccttttaagtcaatttggctgtttaagtggaatgtttgtgtcagtctgataattgttaattcatttgatcctcataccaacccttacttgcctccttttacagatggaaaaatcaaacttggacagtaatttccacaaggaaaagccccacagctggaaagcggtgggagcaggaggccacactgggtacaggagtacccatctccccacaggagccccacactgtctcacccttaggaagcccaaatgctcactccttgagtttctaatgcattctttctgatgtacaggaagaggggaaggaaggaagagcttttccatttggtgctccaatgtctcctgctggacccatctgcctagtggaaggcagcaaaatttcaagaaacaggtgaggttgagcagcttggtgcaaccccatggggcctggagttggagctcaacagcaatggatttcagagaccaccctgaaactcccagtaaaaaagacttgggagacatgttaataaactcaagcatttgatcgacccaaaaaaaaagt

SEQ ID NO: 441849 - DNA, 4050 bp, Homo sapiens
tatagaaggaataatttacttttcagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacatttttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattatttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttgtcctttactttgacaaagtaatgtaatttttaccttatttatctgtatgaaattccagtagttaatttgaacatttatttatatgacgtttgtatttttaggtctttaatacagtgtttctacctctcatttgtaactgcatgcattattcttgaaactaggtaaaactcactgaattgttgtgtaatagcctttttattattgcctgtacaaatgtatattaaggtaaaataaaactgacaaagtgtttctagggtgtagctgggtacatattaagtggcttgttgagccaggtacttccttagtgagtttagagacttggccatgaatatcctttgtcctgccccaggatttagatcttggctactgtcatgcaggcttccaggaacatagactgttttacctccacaaccctatttgttattagtgatactttattttatataatattttttattcacagtgaaatttcattcatgttctttcagttatcacctgtgttatctcagttgtaggtttattctatcctctcctcttcctctcccatttcttttttaacacaggatgaaacaggttcagagaggggaagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccctgaaaaaaaaaaa

SEQ ID NO: 441850 - DNA, 2130 bp, Homo sapiens
tatagaaggaataatttacttttcagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggaagaggggaaggaaggaagagcttttccatttggtgctccaatgtctcctgctggacccatctgcctagtggaaggcagcaaaatttcaagaaacaggtgaggttgagcagcttggtgcaaccccatggggcctggagttggagctcaacagcaatggatttcagagaccaccctgaaactcccagtaaaaaagacttgggagacatgttaataaactcaagcatttgatcgacccaaaaaaaaagt

SEQ ID NO: 441851 - DNA, 2087 bp, Homo sapiens
tatagaaggaataatttacttttcagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatcaccgcaaccgtgtgagcagcaggctcatcccgtggaccggtggtgggaacgtgaggaagaggggaaggaaggaagagcttttccatttggtgctccaatgtctcctgctggacccatctgcctagtggaaggcagcaaaatttcaagaaacaggtgaggttgagcagcttggtgcaaccccatggggcctggagttggagctcaacagcaatggatttcagagaccaccctgaaactcccagtaaaaaagacttgggagacatgttaataaactcaagcatttgatcgacccaaaaaaaaagt

SEQ ID NO: 441852 - DNA, 124 bp, Homo sapiens
atttttaatctgaaattttctaagacaaattgactttgctgcagcgggaacacacagacaccttacgccatctgaatgtgatgctgatgttcactgagtgtgtgctggacctgacagccatgag

SEQ ID NO: 441853 - DNA, 290 bp, Homo sapiens
tcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaaggtttgtttattaaacccttttgtaggtcaggaactggtatagtactttatggaaaggattcattatgagaatagc

SEQ ID NO: 441854 - DNA, 3969 bp, Homo sapiens
tatagaaggaataatttacttttcagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacatttttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattatttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttgtcctttactttgacaaagtaatgtaatttttaccttatttatctgtatgaaattccagtagttaatttgaacatttatttatatgacgtttgtatttttaggtctttaatacagtgtttctacctctcatttgtaactgcatgcattattcttgaaactaggtaaaactcactgaattgttgtgtaatagcctttttattattgcctgtacaaatgtatattaaggtaaaataaaactgacaaagtgtttctagggtgtagctgggtacatattaagtggcttgttgagccaggtacttccttagtgagtttagagacttggccatgaatatcctttgtcctgccccaggatttagatcttggctactgtcatgcaggcttccaggaacatagactgttttacctccacaaccctatttgttattagtgatactttattttatataatattttttattcacagtgaaatttcattcatgttctttcagttatcacctgtgttatctcagttgtaggtttattctatcctctcctcttcctctcccatttcttttttaacacaggatgaaacaggttcagagaggggaagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccctgaaaaaaaaaaa

SEQ ID NO: 441855 - DNA, 1779 bp, Homo sapiens
cccggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagac

SEQ ID NO: 441856 - DNA, 673 bp, Homo sapiens
gcacggggcagtgtacacgggggcagggccgcctgaggggagcgggcagggccaaggcacccactcctgccggtagtgccatggagtagacatctgctctctgcgtctgagccacatggtccccactgctggggcttgctgttggaaacagacagccagttgcataaacagaactgccagctggctcaccgcccagtgatggcagcagggctgttggtgtttgtgtccattccacctgctgctgtgcgggctccggggtgaagatgacttgacagtgacccgatgggcatctttgtaaggtcccgtgttctgtatcttgataaggtcctgcgttctgtatcttgaactgaaaggaatgcacttagccatttgataaatacttttctccacatacatatgtatatttttttctgggtgtgtagaagtaatacagaaatagcagtaattaaaatataacatataacttagaagtgaaagtccccatagcccacctaaagtaatcactcttaacagtttgctgtaacctcaagtgttaaagacattttctatgtaactgtctgtctttaaataagtcctttttttccaccctgagacagggtctcactttgttgcccaggctggtctcgaactcctgagcttcaagtcttggccttggcctgagtagctgggatta

SEQ ID NO: 441857 - DNA, 424 bp, Homo sapiens
acctgcgacagggatgcgcgaggagtcagggggcctcgccggatcgaacctaagctggggaagagtatttcttgtatttttagggcgaagaggtggcagcgcgagctgggaccagcgtctcggaggcgccgcagaattcacagatggattcagtggaaaagacaatattttcaccccaatgtctaatgtaaagaccccgaggtctaggtgtgttgtgtaatggatttgctacaatttcacggtgctgaaagaggatgccctcatactttgcaaaatgggccttgtgaatgaaaaggatcagtcatgtcaggaaaagcgccacaatgatgaaatatgatagataagtcagtctttcatcgtgtaagtagctactatggggtacgaactgtatgaaaactaccactcttgaataagattctgctga

SEQ ID NO: 441858 - DNA, 3279 bp, Homo sapiens
gcccacccacgcacaatctcagtcctcgcaatacccacaagagaaattctcagcctcggggaagagtatttcttgatgagggaagagcgcggggaagacactcacgcacgcacaaacatgtgggcggccatggtgtgcccagcgccgtgctggcttctgggaacccccagtggacaagacggacaaggtaccggctctcaggggaagtgggagccagtcacaagcgtacctaatttcggagagtgacaagtactctgaaaaagaaagaaggtagggctggtgactggccaatttaagcgggcaggagtctgctgggggacggagaccagcctcaggtctgggttggggacagaagctgtgcctaagtgtggtgcaggatgcagttgcaaaggagcgcttccgatcgcacttgatgctcgccacgtccctgcaaagtgctcccgccccctttctgcaaatgaggaaacgggacgcgcggctcgccgggccagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441859 - DNA, 2975 bp, Homo sapiens
gcccacccacgcacaatctcagtcctcgcaatacccacaagagaaattctcagcctcggggaagagtatttcttgatgagggaagagcgcggggaagacactcacgcacgcacaaacatgtgggcggccatggtgtgcccagcgccgtgctggcttctgggaacccccagtggacaagacggacaagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441860 - DNA, 2425 bp, Homo sapiens
gcacggggcagtgtacacgggggcagggccgcctgaggggagcgggcagggccaaggcacccactcctgccggtagtgccatggagtagacatctgctctctgcgtctgagccacatggtccccactgctggggcttgctgttggaaacagacagccagttgcataaacagaactgccagctggctcaccgcccagtgatggcagcagggctgttggtgtttgtgtccattccacctgctgctgtgcgggctccggggtgaagatgacttgacagtgacccgatgggcatctttgtaaggtccttgaatgggcaagagggcacatgaagtacggcgtcctccacattcacggcctctacacggacccctgcggggtggtgctggacccatcggggtataaagacgtcactcaagacgcagaagtcatggtacggcccgtcctaattagcatcggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441861 - DNA, 2318 bp, Homo sapiens
ttttgctatcatgggaccagcatgactggcgctaacagccgatcctctctcaggttttacaggtgtgactgtaccgtcgtaggacgggaataactagggctcacaaccaagtttctcttaggttttgaaggtataagtgtaaagtgaagcatctctcgatgattctttccaagataggtttagatgtgtttctttttcttggcttgatgtttggtaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441862 - DNA, 1820 bp, Homo sapiens
cgcagcccgcgcgggctgacctgcccagaagcctgttcccagtccctgccgttcccagtcactgcctcagggtggccgaggaggacgagctcttggtgtctcggctccactgactgcttttctttctccttcagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441863 - DNA, 1872 bp, Homo sapiens
gtaatgcatgccaggactgtgcaaagaggaagttagaagagaatggaattgaagtttcaaaaaaacgcacacaatcagatactggtaatgcatgccaggactgtgcaaagaggaagttagaagagaatggaattgaagtttcaaaaaaacgcacacaatcagatactggtgtctgtgccatcctcatgctcgcgggagttttggcatgggattctccgttgtgattcccccggactccactgtctgaagaccaggtttcctatgaagagggtctgatgggaacctgttcccagtgatttgaagatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441864 - DNA, 1708 bp, Homo sapiens
cccggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggtacggcccgtcctaattagcatcggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactggtattgtgtctgttctttttgtggggagctgcctcgggtctctcttgttggcaggcatcttcagggaccgtctgcgctttaatgccccgcgccctatggtgggaggacggtgcatacgttctgtcagggccagagagcacaggaggcttacttagcagagaccctgacctctcaccccaacccgattccaactgcccagagctactggtacctctttagaaaaatgttacggagaaaacatacactaagaaggtgcagcgggcagaaggtgctctctccaa

SEQ ID NO: 441865 - DNA, 1939 bp, Homo sapiens
cccggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggtacggcccgtcctaattagcatcggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactggtgtctgtgccatcctcatgctcgcgggagttttggcatgggattctccgttgtgattcccccggactccactgtctgaagaccaggtttcctatgaagagggtctgatgggaacctgttcccagtgatttgaagatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagac

SEQ ID NO: 441866 - DNA, 2971 bp, Homo sapiens
cccggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441867 - DNA, 3809 bp, Homo sapiens
cccggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttcaaccctgtgtgctcagtgtttctttagttatgccaaggcttgctagaatgttatttagtgagaatttttagcttgagttgccacccaactgtgaaatcaactaaatgattacttgaatgtatttaaatgttttaaaaagcaaacattataaatttttctttaatgtcatttagtaagtgcagtcagggaatatctgaatctaagagctggccagacacagggtatagcagaattacaagcatagaggatgctatgcagtaggatgtaaagctcattacagcccatttttaagaaaagctttgtgtgctctgctggaggacacagccatgttgctgcaccacatggatgtatctagtcagttctgttgtatgctcgttgtagaatgtaaagtttattccaatccgattgatagattaaaggcaattccagcatagtgcacttgcttgtgtatagtttagtccgtgagaaacatcacatcaggaggtaacaaagttggccctgctgtttactgcctcaagctagagtagctattacattttaaaatggttatattttaagacagggcaggtagctcaaacctgtaatcccagcactttgggaggctgaggggggcggatcacttgaggccaggagtttgagaccagcctggccaacatggtgaaaccctgtctctactaaaaatacaaaaattagcctggcgtggtggcgtgtgcctgtaatcccagctacttgggagactgaggcaggagaatcacttgaaccaaggaggcagaggttgcagtgaaccaagattgcaccactgcactccagcctgggcgacagagggaattccatctaaa

SEQ ID NO: 441868 - DNA, 2400 bp, Homo sapiens
gcacggggcagtgtacacgggggcagggccgcctgaggggagcgggcagggccaaggcacccactcctgccggtagtgccatggagtagacatctgctctctgcgtctgagccacatggtccccactgctggggcttgctgttggaaacagacagccagttgcataaacagaactgccagctggctcaccgcccagtgatggcagcagggctgttggtgtttgtgtccattccacctgctgctgtgcgggctccggggtgaagatgacttgacagtgacccgatgggcatctttgtaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441869 - DNA, 2180 bp, Homo sapiens
cccgtggcctacctctgactggtgtgcacatcgcgggtagggcctactgcctggtagaccttgctgtggagcattgggcaggggttttcttcaatacctgtgagatctgtgctcctagacgccatcacctgcacctgcagccccggctctccccacccagtcatgtctccttagggcgaagctcctggcctctgttgtacagaaagccctggcctgtcctgcatgtgggtgagagaagccaagcctggggatcccagaggaatcgacaggcttattcttctccatacctccaacaggctctcactgtatgtttgttgaaattgccccatcctcagtccactaagaaataaaagagcatccatgttcatggattgagattcccacagatcgttgcaaatgtaatgtcatcatttgcttgatcccctgatagtactgataattacacaaggtcatttccagacagtggctactgtttccattgtggaggggttttcaaagtcttccgtacataagaacaattgtaaagcagtttctgaaatagaaatctattgcaaataacttcttttagctggactttaacccttgggcatttcattcttttatttaaacagatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgtggaaacatgttactatagaaagcattttaaaggtacgttttaaaggtccactgttaaatagtaaagaatgaatccgctagcgaaaatgtttttagggagaacagctggatcaaaagggcttctttggaattaggttgttttagtaacttctgttccaaagaaacacaggtctgatattgctaagaactgaaatcggaggagccagaggcccttttcagtccaggccaacattgtgcacggccactgtgggactgacaaccgggatagctcaagttcgagagaccaggtttcaaacattataagttccaggctttgcaagtctttattctctggggtaatatccagtctttctgttattgtctcttaaaattctcttccatggcccacattaagggagtttgcagagagtgagggaggcaaaacttgaaaagggcctgcaacactttaaaccttctcaggttcacccacatgaaacggctgtgctgagtgtgctgccggtgcccggggagcttctctgactgtgacccggcagaggcttctgtggcggtgcatgagcggccctacagtggagggttctctttggaaacaaacagccctgcttggtttcagtttgaggccacttatcttcaatgtgacatttcttgccaagccctgtgacactccccattgatgactcccataggtacagataaagttaagaacaggaaacagaagggtaggatgcatagggagggagagaagccctgaaaactttttttttctttttgaagcatggaaaacaaatcttttatgccactccagccataaataaaattttaacttca

SEQ ID NO: 441870 - DNA, 1950 bp, Homo sapiens
cccggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtccttgaatgggcaagagggcacatgaagtacggcgtcctccacattcacggcctctacacggacccctgcggggtggtgctggacccatcggggtataaagacgtcactcaagacgcagaagtcatggaagtcctccagaacttataccgcaccaagtcctttctgtttgtgggctgtggggagacccttcgtgatcagatattccaggccctctttctttactccgtgccgaataaggtggatttggagcactacatgcttgtgctgaaggagaatgaagaccatttctttaagcatcaggcagatatgcttctgcacggaatcaaagttgtatcctacggggactgttttgaccactttccaggatatgtgcaagaccttgccactcagatctgcaaacagcaaagcccagatgctgatcgcgtggacagcaccacattattgggtaatgcatgccaggactgtgcaaagaggaagttagaagagaatggaattgaagtttcaaaaaaacgcacacaatcagatactgatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacacttttttttttttgaggcaggagaatcgcttgaacccaggaggtggaggttgcagtgagcagagatcgcgccaccgcactgcagcctgggcaacagaacgagactacgtgtcaaaaaaagaaaaag

SEQ ID NO: 441871 - DNA, 1101 bp, Homo sapiens
cccggggcggggcctccggggaccgcggggccgttggtttcgggacggaacgttcacgcggctggggcgggcgcgcgggggaagggtttgcggcggcgccgctgccggctaacgcggaggggcgcctggaggcggcgtggcgtccgctctggctccgactccggctctcgctctcgcttctagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagatggattcagtggaaaagacaacaaatagaagtgaacaaaaatccagaaagtttttaaaaagcctcatccggaaacagccccaggaactgctcctggttatcgggactggcgtcagcgcagcagtggcccccggaatccctgccctttgctcgtggagaagctgcatcgaggccgtcatcgaggctgcagagcagctggaggtgctgcaccccggagacgtcgccgagttccggaggaaagtgacaaaggaccgggacctgttggttgtcgcccatgatctgatccggaagatgtcacctcgcacaggcgatgccaagcccagcttcttccaggactgcctgatggaggtgtttgacgacctggagcagcacatccggagtcctctggtgctgcagtcgatcctcagcctgatggacagaggcgccatggtcctgaccaccaactatgacaacctgctggaggcctttggccggcggcagaacaagcccatggagtccctggacttgaaggacaagaccaaggtatgggctgggggtgcgggaggcctttggccggcggcagaacaagcccatggagtccctggacttgaaggacaagaccaaggtatgggctgggggtgcgggaggtctttggccggcggcagaacaagcccatggagtccctggacttgaaggacaagaccaaggtatgggctgggggtgcgggaggtctttggccggcggcagaacaagcccatggagtccctggacttg

SEQ ID NO: 441872 - DNA, 457 bp, Homo sapiens
tgagacctaggattcatgggagtgcagcccgggaagaagacgaacacccttatgaactgttgttaacatcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatgaacgca

SEQ ID NO: 441873 - DNA, 3515 bp, Homo sapiens
acaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaaggctgggacagagaacagtgacaatggtaacaggctggggcagggggtgccagaggcatgcctgagcctgagaattccagaacacggctttccccagcagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttaaacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatgaacgca

SEQ ID NO: 441874 - DNA, 2714 bp, Homo sapiens
acaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttaaacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaaatatttctgggcttccagctttggttttgttattttcataactgtacacaacttagaacagactgaattaataaatgagaagcgacatgaacgca

SEQ ID NO: 441875 - DNA, 1951 bp, Homo sapiens
acaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttaaacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaccactgaggaaccacactgtgctgcggaaacatagacgtgggggcataggctcccactgccaccaccgccatcgcctcacctgcagctcgaagacccagagacacttgcatcaagagggccgacc

SEQ ID NO: 441876 - DNA, 3416 bp, Homo sapiens
acaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttaaacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatgaacgca

SEQ ID NO: 441877 - DNA, 3517 bp, Homo sapiens
acaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttaaacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatgaacgcaaaaaaaacgggggggcccccgcgggctaaaaccactcgatcttaaacgggagggcgcctaaaaatacccggggggcacagtacgtacccgtttttacaagg

SEQ ID NO: 441878 - DNA, 2067 bp, Homo sapiens
acaccagccagagaaactcatcttcgagtcctgtggttatgaagccaattatctgggctccatgctgatcaaagatctgcgagggacagaatccacgcaagacgcctgtgccaagatgcggaaatctacggagcacatgaagaagatccccaccatcatcctgtccatcacatacaaaggtgtcaagttcatcgatgcctccaacaagaacgtcattgcagagcacgagatccggaacatttcctgtgcggcccaggacccggaggacctctgtacctttgcctacatcaccaaggacctgcagaccagccaccactattgccatgtgttcagcaccgtggatgtgaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcactggaaccacctgatatggaccaagatgcccaatcccatgccagtgtctcctgggttgtggaccccaaaccagactctaagcggagcctcagcaccaactgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttaaacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagacggcggtggcctgcgggtgaggggaacggagcaggctcaggcagaattgagtacggtgcgtctgcttttcaaacccaacatatcagctgctgctctttatgaactgccaacttcctgtccctttcagggggctagacacaggcttctcgtaagaacacagctttagaggcacctgagcaactcaaaggtttccggtccatttctggggttccgatgggaaggttcagtggcaatgaagata

SEQ ID NO: 441879 - DNA, 935 bp, Homo sapiens
cagaggctagattgaattcacctctgcattcccatcctgttcattttcacttgccactttcttatttgcaaataagaaagtacctgctattttcctcagcgaatctgccattgaaaattgcctcttggtctgtgtaaatttaaattgcagtagcttattgttttcatagggtagttgacatctaatacctctattctgagaggggaaatcatttttttttgtaaaactaactgcttctctttattttctccctataccagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtaaatataaatttggttgagatctggagggggggagggagctattagagaaggatgaggcagaccatgtacagttaaaattataaaatggggtagggaatactggagatatttgtacagaagaaaaggatatttatatattttcttaaaacagcagatttgctgcttgtgccataaaagtttgtataaaaaaaatttgtactaaaagttttatttttgcaaactaaatacacaaagcatgccttaaacccagtgaagcaactgagtacaaaggaaacaggaataataaaggcatcactgaccaggaatatctgggctttattgataccaaaaataaaaa

SEQ ID NO: 441880 - DNA, 5299 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccattgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcaattttgaaccctccaccatccccagccacagagcgatcacattacactatggaatttggatattcttcaaacagtccttccactcataggtcatacagctacaggccatatagctaccggcactttgcaccccccaccacaccctgcagcacagatgtttgtgacagtgactatgctcctagtcggagaatgacctcagtggcaacagccaagggctataccagtgacttgaactatgattcagaacctgtgcccccacctcccacaccccgaagccaatacttgtcagcagaggagaactatgaaagctgcccaccttctccatacacagagaggagctattctcatcacctctacccaccgccaccctctccctgtacagactcctcctgaggaggggccctcctcctctgactgcctccaacgtaaaaatgtaaatataaatttggttgagatctggagggggggagggagctattagagaaggatgaggcagaccatgtacagttaaaattataaaatggggtagggaatactggagatatttgtacagaagaaaaggatatttatatattttcttaaaacagcagatttgctgcttgtgccataaaagtttgtataaaaaaaatttgtactaaaagttttatttttgcaaactaaatacacaaagcatgccttaaacccagtgaagcaactgagtacaaaggaaacaggaataataaaggcatcactgaccaggaatatctgggctttattgataccaaaaataaaaa

SEQ ID NO: 441881 - DNA, 564 bp, Homo sapiens
gcacgagtatctctatcgcccatcctgcatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaaaaaactgtcctttcttttcagc

SEQ ID NO: 441882 - DNA, 5916 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccaggtaattgagagcttggttcaaaattcatttctcctgactaataactggactcaccaaccactctgtttcacttaagtcttgactctgcttaagtgtgtgtgtatgtgtgtatgaaactgaaattatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattaaaaatagccatcatctgtattaggtagcagttttggaggatcatctttttcttttgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaaaaaactgtcctttcttttcagc

SEQ ID NO: 441883 - DNA, 5862 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccaggtaattgagagcttggttcaaaattcatttctcctgactaataactggactcaccaaccactctgtttcacttaagtcttgactctgcttaagtgtgtgtgtatgtgtgtatgaaactgaaattatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattaaaaatagccatcatctgtattaggtagcagttttggaggatcatctttttcttttgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacagcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaaaaaactgtcctttcttttcagc

SEQ ID NO: 441884 - DNA, 3562 bp, Homo sapiens
aatttaacaatgaggattaaatgagaaggcaaactgttaacttctcagctgtcagaatttgggtggaagggaataatggaagcctcttttgtgatctgcctgacctgctgtcatgtatggtactggggctgctacatcttgagctatcagggctgacctgtggaatgattctagcacttgctctgccaccttgccagaagttcgtttcctgctttttacacatgtgtagcacttctctgctaaaattgaatggttttaaactaatgtatttttagcttaagaggtgttggtcagttaattattgaattttttttttttcttttttaattctgtcttgccaaggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagagtcctaaaacagacaagcatgaactcttcccattgctggaactaagtgcccacagtgtcagacgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattatgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaaaaaactgtcctttcttttcagc

SEQ ID NO: 441885 - DNA, 5809 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccaggtaattgagagcttggttcaaaattcatttctcctgactaataactggactcaccaaccactctgtttcacttaagtcttgactctgcttaagtgtgtgtgtatgtgtgtatgaaactgaaattatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattatgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaaaaaactgtcctttcttttcagc

SEQ ID NO: 441886 - DNA, 4702 bp, Homo sapiens
  misc_feature (4648)..(4648): n is a, c, g, or t
  misc_feature (4657)..(4657): n is a, c, g, or t
  misc_feature (4666)..(4666): n is a, c, g, or t
  misc_feature (4675)..(4675): n is a, c, g, or t
  misc_feature (4686)..(4686): n is a, c, g, or t
  misc_feature (4696)..(4696): n is a, c, g, or t
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccattgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggaaactatgactaatgactatgtagttcatggaccagcttctgtgcctcttggttatgtgccacacccaagttctttgtcaggatctcttccaggaatgtctcgaggtaaatcaatgatcagctccctcagtatcatggggggaagcagtggacccccctatgaccgagcccatgttacaggagcatcatcaagtagttcttcaagcaccaaaggcacttacttccctgcaattttgaaccctccaccatccccagccacagagcgatcacattacactatggaatttggatattcttcaaacagtccttccactcataggtcatacagctacaggccatatagctaccggcnctttacatntcccctccnctcccctgnttaataaactntaaaaatccncttgta

SEQ ID NO: 441887 - DNA, 1038 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatggtaagtgatccttgatttttaaattgcaagttggaacagctttgtagcactctaatgtctggctttagtgaggatcaggaggagggagggcatatccaaagatagttggcgggaata

SEQ ID NO: 441888 - DNA, 203 bp, Homo sapiens
caaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggtaagattacaagaattagaaaaaacttttaagaaaa

SEQ ID NO: 441889 - DNA, 579 bp, Homo sapiens
cctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaa

SEQ ID NO: 441890 - DNA, 5862 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccaggtaattgagagcttggttcaaaattcatttctcctgactaataactggactcaccaaccactctgtttcacttaagtcttgactctgcttaagtgtgtgtgtatgtgtgtatgaaactgaaattatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattatgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaaaaaactgtcctttcttttcagc

SEQ ID NO: 441891 - DNA, 5862 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccaggtaattgagagcttggttcaaaattcatttctcctgactaataactggactcaccaaccactctgtttcacttaagtcttgactctgcttaagtgtgtgtgtatgtgtgtatgaaactgaaattatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaaacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattaaaaatagccatcatctgtattaggtagcagttttggaggatcatctttttcttttgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaaaaaactgtcctttcttttcagc

SEQ ID NO: 441892 - DNA, 5468 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagaggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccaggtaattgagagcttggttcaaaattcatttctcctgactaataactggactcaccaaccactctgtttcacttaagtcttgactctgcttaagtgtgtgtgtatgtgtgtatgaaactgaaattatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattatgctataaagccctattaatgaagaatacttccagtagagttaatagctgtagcttacctagtgtgttaatgaagtgtgtttatttatgtgacttgataccagtagtcataatagagactgaagaggtatgcgttaagcacgcctacttctatgcagtaaacaggctgcagctgcctagattagattcttagaaatgtcatattttgaattgttttatttcttgtaggggaagctttgtcccacttcattcatttgcatgccataggaattacatattggttatcattacgtatctaacaagattcagaaacaaaaatcttggacttttcacatccgaaatatgtcagctcttaataaatgtgtggtgcttaagtctacatatggcatccatagttgatttagagtatggatatgagtgtgttgaccagttatcagtaggtggacaaatatttgggcatctacagatgagactatgcactaagtgtggactgagtcctaaagaagcttatagtcaggtgttgtttaaaacattatcagaattcttaaacccaaggaatttaattttatttggtatttcttaagcctaaaatgaaccaagagaaagatgattttagaaagtacttgtagtgaaagatgattttagaaagtacttgtagtgcatgtgtggcttctgacttttgggatggcaccattttataatagtttcaaaatttagcttttgaaattctcaacattttatggtagaagactttggacctcaagtataaaattatacgtttataatttttttaaaatttaaattataagtattgtgaattcacactctcaggctattgtctgacttgatctacgtctcataaagcctgtacctgagtggagtggaaggtggagtcttaggttaatcagttactgactctaccctcaccctctttcaattgaggtaaactttgctgtttttctttttcataaagcattctcaaattgttgagtttattgctgaaaaaaatctccatgactttacagatagaattacaaactaaatgatgtcttgtatttagaagcagagtacagacctaacgaactgttagattctccaccatcacttagggtttgcccagaagcaacaccagagaattacagacaacgcgcttttgctgaactgtccattttggtggttgtgtttttcagtcaaatataagcaggatgggcgatagagatatatttatatatagatacatattctatatatctaatgcctaaatatgggtattaaagggaaaatttttaaagtctgattaaatccaatatgacatgaaattaaatatatggattagtaaggaaaaatgttaaaaagtagagaggataccaagaagattaaactggactagccttatttgcaagtgaaggatctggtgctgctttcagatgtttatcttttatttttttcccttaagctttaatcttcgtcattgtcttaaagtcaactggtgtttcttgttcattgactttggtacgatggtgctttgcaaggatgtatttatgttataatggccaacatttggtcagcccttgtccacttattcacttccctccttttgtaaaataagtgctttaattataaactgtataaaaataccttgtataaaccccttttttgattattacaataaataagctgaattgtaacaaatgaaatttgatttttgtaataaaacagtggaaaagtaaaaaaaactgtcctttcttttcagc

SEQ ID NO: 441893 - DNA, 4367 bp, Homo sapiens
gcggccgccccggctcctcgcctcccccacttctggccacccctcgccggtgagagaagagaacgcgagaagggaagatgggggccgtcctgaggagcctcctggcctgcagcttctgtgtgctcctgagagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggttcatgtactggacagactggggagaagtgccaaagatagaacgtgctggaatggatggttcaagtcgcttcattataataaacagtgaaatttactggccaaatggactgactttggattatgaagaacaaaagctttattgggcagatgcaaaacttaatttcatccacaaatcaaatctggatggaacaaatcggcaggcagtggttaaaggttcccttccacatccttttgccttgacgttatttgaggacatattgtactggactgactggagcacacactccattttggcttgcaacaagtatactggtgagggtctgcgtgaaatccattctgacatcttctctcccatggatatacatgccttcagccaacagaggcagccaaatgccacaaatccatgtggaattgacaatgggggttgttcccatttgtgtttgatgtctccagtcaagcctttttatcagtgtgcttgccccactggggtcaaactcctggagaatggaaaaacctgcaaagatggtgccacagaattattgcttttagctcgaaggacagacttgagacgcatttctttggatacaccagattttacagacattgttctgcagttagaagacatccgtcatgccattgccatagattacgatcctgtggaaggctacatctactggactgatgatgaagtgagggccatacgccgttcatttatagatggatctggcagtcagtttgtggtcactgctcaaattgcccatcctgatggtattgctgtggactgggttgcacgaaatctttattggacagacactggcactgatcgaatagaagtgacaaggctcaatgggaccatgaggaagatcttgatttcagaggacttagaggaaccccgggctattgtgttagatcccatggttgggtacatgtattggactgactggggagaaattccgaaaattgagcgagcagctctggatggttctgaccgtgtagtattggttaacacttctcttggttggccaaatggtttagccttggattatgatgaaggcaaaatatactggggagatgccaaaacagacaagattgaggttatgaatactgatggcactgggagacgagtactagtggaagacaaaattcctcacatatttggatttactttgttgggtgactatgtttactggactgactggcagaggcgtagcattgaaagagttcataaacgaagtgcagagagggaagtgatcatagatcagctgcctgacctcatgggcctaaaggctacaaatgttcatcgagtgattggttccaacccctgtgctgaggaaaacgggggatgtagccatctctgcctctatagacctcagggccttcgctgtgcttgccctattggctttgaactcatcagtgacatgaagacctgcattgtcccagaggctttccttttgttttcacggagagcagatatcagacgaatttctctggaaacaaacaataataatgtggctattccactcactggtgtcaaagaagcttctgctttggattttgatgtgacagacaaccgaatttattggactgatatatcactcaagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaaggatttatgtattggactgaatggggtggaaaacctaagatagacagagctgcaatggatggaagtgaacgtactaccttagttccaaatgtggggcgggcaaacggcctaactattgattatgctaaaaggaggctttattggacagacctggacaccaacttaatagaatcttcaaatatgcttgggctcaaccgtgaagttatagcagatgacttgcctcatccttttggcttaactcagtaccaagattatatctactggacggactggagccgacgcagcattgagcgtgccaacaaaaccagtggccaaaaccgcaccatcattcagggccatttggattatgtgatggacatcctcgtctttcactcatctcgacagtcagggtggaatgaatgtgcttccagcaatgggcactgctcccacctctgcttggctgtgccagttgggggttttgtttgtggatgccctgcccactactctcttaatgctgacaacaggacttgtagtgctcctacgactttcctgctcttcagtcaaaagagtgccatcaaccgcatggtgattgatgaacaacagagccccgacatcatccttcccatccacagccttcggaatgtccgggccattgactatgacccactggacaagcaactctattggattgactcacgacaaaacatgatccgaaaggcacaagaagatggcagccagggctttactgtggttgtgagctcagttccgagtcagaacctggaaatacaaccctatgacctcagcattgatatttacagccgctacatctactggacttgtgaggctaccaatgtcattaatgtgacaagattagatgggagatcagttggagtggtgctgaaaggcgagcaggacagacctcgagccattgtggtaaacccagagaaagggtatatgtattttaccaatcttcaggaaaggtctcctaaaattgaacgggctgctttggatgggacagaacgggaggtcctctttttcagtggcttaagtaaaccaattgctttagcccttgatagcaggctgggcaagctcttttgggctgattcagatctccggcgaattgaaagcagtgatctctcaggtgctaaccggatagtattagaagactccaatatcttgcagcctgtgggacttactgtgtttgaaaactggctctattggattgataaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagtttacttgtttcacgggggaaattgactgtatccctgtggcttggcggtgcgatgggtttactgaatgtgaagaccacagtgatgaactcaattgtcctgtatgctcagagtcccagttccagtgtgccagtgggcagtgtattgatggtgccctccgatgcaatggagatgcaaactgccaggacaaatcagatgagaagaactgtgaagtgctttgtttaattgatcagttccgctgtgccaatggtcagtgcattggaaagcacaagaagtgtgatcataatgtggattgcagtgacaagtcagatgaactggattgttatccgactgaagaaccagcaccacaggccaccaatacagttggttctgttattggcgtaattgtcaccatttttgtgtctggaactgtatactttatctgccagaggatgttgtgtccacgtatgaagggagatggggccaacattaatgtcggcccatgcaacaacagggagctcactcaggggtttgatgtggtggatgctggctcg

SEQ ID NO: 441894 - DNA, 362 bp, Homo sapiens
gactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggtaagtttttgtacagtgtacgaagatcatcatacctcctttcggtttttctccactgacatacaccaccctgacccctat

SEQ ID NO: 441895 - DNA, 946 bp, Homo sapiens
agaatggcttcggctcctttcgccgccggtattctggtgtatatgatcccactctcactctcataggagacgatctcgaagtagatcatatacaccagaataccggcggcgaaggagccgaagctcaagggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggataacaacattgtgatctgtactacaggaaccaaatgtcatgcgtcatacatgtggctataaagtacataaaatatatctaactattcataatgtggggtgggtaatactgctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaaatttttttagttctaatcattgatgatagcttggaaataaataattatgccatggcatttgacagttcattattcctataagaattaaattgagtttagagagaatggtggtgttgagctgattattaacagttactgaaatcaaataatattatttgttacattattccatttgtattttaggtttccttttacattcttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgtattaaccttgagtattgcagtt

SEQ ID NO: 441896 - DNA, 777 bp, Homo sapiens
taagtgcctcatatctgtgcagttaaaaaaaacaagcttatgatcagtaagttattttatttggaatgctttgatttacacccaattttttcagaaacccatcactttttggatatagaatatagtcactgaagggagtaccagtatacataaatgcataaattatgtaaaaactgaacataattctaaagagatggaatcaaagataaagactatgatataaattttgtaccttcttgcacattgtggtatgtcgtggataatagagcattttaaagtgatctggttgcaaaaatgtgtatatcaggaattaataagctaatggggaaattttaagaatttcatgcttattagttttttcggtatgtttgtcttcagaacatattttaagtcagaatgagcaaagatagtagtcaaagttgggagaaggtgtaattttactgatttttttctttttgacttatttgaaccttgacatgtgctatgggtgagtttagataggtgtgtacaaatatttcagcctgggatgccttgctctaactatatcttgatttcttagcatgacttagtgaaagcttatttttaagaatcttcagattataaagtagtgaaaatttaacacttaggtggggggaaattatagttgttagatttatatttgaattatattaaaattgctcacattttaggaactagaatgaaacatggttcgaggggtcataatagtgtttatggagattgtaagatatattattattttttctttgtttgtagact

SEQ ID NO: 441897 - DNA, 1632 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441898 - DNA, 2239 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441899 - DNA, 2811 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttgaaaaaaaacacacaacccacacgcgcaccgaaacaacccagcgaccaacagcagtcgccactccgggcgggggacccacataagcgatcccccgccggaggcgcaccaagacagagccgcacccacgtagtggcgccacgaaggtggccacttaagcagcgcctaattcagacgcacgccagcccgcgacaaaacgagccccgatgtaaaggatcctccgcaggcacgttgcgagcccacctgcgcctgaggggcacaagtcgcgacatcgacgcagcaaaaaccacgagcaatcagtcacagagcatcaggctacaaacgcgattgcacgcgtcaacggcccagatgaaagaaaca

SEQ ID NO: 441900 - DNA, 1160 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggttagtcaacgaccgcaccgacccttaagcgttcttaagacgagagctgtgaggggaaactacgcaaggagcccttttcccttaatgtcccttcgactttcctttcacttcgaaatgaatgtggaaatgctgtcacgccttatttttctaattcctcgatgttgggttttttctcttctttatatctcaacttttaatgctcttcttcctatgacctttcatctaaaaactgaccactcctttacaggtttttacggtaaaaaaagggcgccgctcagatcctctagagcgccc

SEQ ID NO: 441901 - DNA, 2050 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441902 - DNA, 1472 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggttagtcaacgaccgcaccgacccttaagcgttcttaagacgagagctgtgaggggaaactacgcaaggagcccttttcccttaatgtcccttcgactttcctttcacttcgaaatgaatgtggaaatgctgtcacgccttatttttctaattcctcgatgttgggttttttctcttctttatatctcaacttttaatgctcttcttcctatgacctttcatctaaaaactgaccactcctttacaggtttttacggtaaaaattaagataactagtcagtatatactgttctgtaacttaaaagatgacctgaaaattaacaggccctctcccatttctcttctcactctatcccccaccgaagagggctcagaaaaaagtttttattaatatatttggggtcggagaaatacaaacatcacaaagaatacgatatccccagcttaaatgtactggaacgtttgtcagtgagtttcatttccaaagtttaccctacatagggaattgtagaagtgagttagtagaagtgagttcgtgtgaaaccctggaaagaaaacgccactggaaccgtccggctgtggtgaagtttttctctcacttggggc

SEQ ID NO: 441903 - DNA, 2915 bp, Homo sapiens
taagtgcctcatatctgtgcagttaaaaaaaacaagcttatgatcagtaagttattttatttggaatgctttgatttacacccaattttttcagaaacccatcactttttggatatagaatatagtcactgaagggagtaccagtatacataaatgcataaattatgtaaaaactgaacataattctaaagagatggaatcaaagataaagactatgatataaattttgtaccttcttgcacattgtggtatgtcgtggataatagagcattttaaagtgatctggttgcaaaaatgtgtatatcaggaattaataagctaatggggaaattttaagaatttcatgcttattagttttttcggtatgtttgtcttcagaacatattttaagtcagaatgagcaaagatagtagtcaaagttgggagaaggtgtaattttactgatttttttctttttgacttatttgaaccttgacatgtgctatgggtgagtttagataggtgtgtacaaatatttcagcctgggatgccttgctctaactatatcttgatttcttagcatgacttagtgaaagcttatttttaagaatcttcagattataaagtagtgaaaatttaacacttaggtggggggaaattatagttgttagatttatatttgaattatattaaaattgctcacattttaggaactagaatgaaacatgggaggagggtgaagagtatggtttaaaaagcatttagagaaatttagtaaattctctttgttagaaactagagttttgaacaattttaaagactataaaattgttttttttttttttttaaataaactagttacttgcactttacctgctggcttttccatttggtagataacattctgaactccagcagagttttataatccccacgtgcttaaatatactaaatgttctttttccattaaggttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggttaagtaaatgtatggtttatgttccagtgtctgtatgatcaagttgtagatgaatttgcatgattacttagttaatagagaattggtgatctggttcaagtagggaattattgaggacagttagcagtattaacagtgggttattattgagctgaaattttttctggagggtgttgtctaaccatttgtttttcaggagcaatcaatataaataattacggtactttaaatgttaggtgttaggcatctacatgaccagtgccatttgtaatactgtcttctttgttaggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441904 - DNA, 2758 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtatactagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttgaaaaaaaacacacaacccacacgcgcaccgaaacaacccagcgaccaacagcagtcgccactccgggcgggggacccacataagcgatcccccgccggaggcgcaccaagacagagccgcacccacgtagtggcgccacgaaggtggccacttaagcagcgcctaattcagacgcacgccagcccgcgacaaaacgagccccgatgtaaaggatcctccgcaggcacgttgcgagcccacctgcgcctgaggggcacaagtcgcgacatcgacgcagcaaaaaccacgagcaatcagtcacagagcatcaggctacaaacgcgattgcacgcgtcaacggcccagatgaaagaaaca

SEQ ID NO: 441905 - DNA, 2224 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggttaagtaaatgtatggtttatgttccagtgtctgtatgatcaagttgtagatgaatttgcatgattacttagttaatagagaattggtgatctggttcaagtagggaattattgaggacagttagcagtattaacagtgggttattattgagctgaaattttttctggagggtgttgtctaaccatttgtttttcaggagcaatcaatataaataattacggtactttaaatgttaggtgttaggcatctacatgaccagtgccatttgtaatactgtcttctttgttaggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441906 - DNA, 1944 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggttaagtaaatgagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441907 - DNA, 1482 bp, Homo sapiens
taaaagaagatggggccttaacatttttgtaaggttaggtgaaaagggtgaatgtagaggggcttgactgagaagagtggaagatgtagtgacttaagtgaaccaaaggaagaataccctttcctcagaagcaaggaggaaggacctgagaatagttagggatatatgtataccttcttggaagagggaaggactttagccattttgtttcagtatttttacctaaatgtatttctctcaaaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441908 - DNA, 1624 bp, Homo sapiens
aatgacctttagtttatgggacactcttacggagaaatatttgtggatacataaaaattgtgtagtttttattagtttattatacttttattagttcagtctcaataaaaggttgaaaggcattacgataaatttgttcttgtctgtttatatcatttcttcttggctgctcactgagtcttaatcagtgtactagactgcaaactaaagaataagattgggggcaggttataaaaagaacatgtataaagcttagcaaaccctttttaatgttctgaagtcagtctttgtaagtgaaatcgctggagactagaaagtatgaaatggcagtctacctgggcaacctacaaaaaatttagcttgaaaagacttcagtctccgctcccctgttgatctcatggagtggggaatgggaattgaaccagaactggaaaattatttaggaaagtttgttaactactctttgttgatctcatggagtggggaatgggaattgaaccagaactggaaaattatttgggaaagtttattaactactctttctgctgagtaaatttaaatgtgttctggacattgttgaggtctagaattgtctatacaatgccctgtacaagctacattgctgtcattttcaaaatcaggagtttatttggattacatatactttgtgcttaattttaagtaatgattacttcaagactggtgaattatacgtgactttttgtgcctgttctttataggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441909 - DNA, 1271 bp, Homo sapiens
ccaaaggcagtattcacagaggtatttcttgggaataaaagaaggaatatagtcattccttggtattctctttggtgtccagagttacttaaaaattcttggtgtttattgccttttagtcacagggatacaccttttattcatttatttatttatttaccagtctcatttagcagtaggaatgcatcttagcatttttatactgctgctcaacacagtgcttcatcgtttcaatttgttgaaaagattttaatttgggcagtgcattagtagaaaagcagttaatagttttgagagttttgtgaagcccttcttgattatgtatgtagggaataaggcaaaccagaataccatgggagtcagtaaaatgagatacggaggcaatttctcatgaaagggatgttcttcctcacttttctcttttttaagccattcaatttgtattaaagtgtcctggaaaatagtcattcacactaatggagaatttttacatttttctgcagtagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441910 - DNA, 757 bp, Homo sapiens
  misc_feature (724)..(724): n is a, c, g, or t
  misc_feature (727)..(727): n is a, c, g, or t
  misc_feature (730)..(730): n is a, c, g, or t
  misc_feature (755)..(755): n is a, c, g, or t
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaatattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatatggtgggggtggtggaagangcngcngcggtggaagtggaagtggtggcanac

SEQ ID NO: 441911 - DNA, 341 bp, Homo sapiens
ttttctggtctcattggcagaaagagaacttaatattaagtagttatcaccttaggtacattattattttgaatgatgaggaatttttattttcatctgcctcagtggagtgattatatagtatgctaagtaatctttcatttcttacagaagacgatcaccttctccttattatagtcgatatagatcacgatcaagatctcgttcctacagcccaagtatgtgaactttacttttgtagcataaaaaacctcatttctaattaatggcttactttagaatattagagtataaggtggaaggtggcagttaatagttggaaaaatatgaggcaaattaaa

SEQ ID NO: 441912 - DNA, 2188 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggttagtcaacgaccgcaccgacccttaagcgttcttaagacgagagctgtgaggggaaactacgcaaggagcccttttcccttaatgtcccttcgactttcctttcacttcgaaatgaatgtggaaatgctgtcacgccttatttttctaattcctcgatgttgggttttttctcttctttatatctcaacttttaatgctcttcttcctatgacctttcatctaaaaactgaccactcctttacaggtttttacggtaaaaaaaaaaaaaatctgtctttctttaatcttacatagctgaacgaattcattggctcagtatttttaagataactagtcagtatatactgttctgtaacttaaaagatgacctgaaaattaacaggccctctcccatttctcttctcactctatcccccaccgaagagggctcagaaaaaagtttttattaatatatttggggtcggagaaatacaaacatcacaaagaatacgatatccccagcttaaatgtactggaacgtttgtcagtgagtttcatttccaaagtttaccctacatagggaattgtagaagtgagttagtagaagtgagttcgtgtgaaaccctggaaagaaaacaaaagccccatgcaacacgttccgggctgttgtgtagatgtttattctagtcactaggggaagcacataaaaacacctgaggtgtgtgtgctgaagggcgaattttgtccttttggggagttcatgatataaacatctagaaccaaaaagtcaaatcagaaggtcagtttaggctttagttctctttgaggaaagatttaaagcaatagactataatagttacccggtagactaaaaaatttgcctttaattcttttgattggaatttttttttacaaagtttggagcatggaaacaaatgaaaattgaacctgcttattttttaggatggtgtattgatggccccaacagaactttctaaaatcatgcgataaacatatatgatagtagttgtaaaatgcttcttgttttgaaaatgttgagtaattatcgatagaaattttgctgtccattcatacattccttcaattaactttcattgttaaaaaattgggggattgatgtttggtttggtttgtggggagtgaagaggactactggagggaccttgtttgcttgctttttttctttttttaatttatcatcaagtctaggaaaggagtaagttgccgacaattgtcacttttccctcctaagaaagtaacatgttaagattcccacctaccagcctgggtgacagtgagactcccgtctcaaaaaaaaa

SEQ ID NO: 441913 - DNA, 2416 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagtatgtgaactttacttttgtagcataaaaaacctcatttctaattaatggcttactttagaatattagagtataaggtggaaggtggcagttaatagttggaaaaatatgaggcaaattaaactataattgttaactttttttttttttttttttttttgggttttcctcttttgggacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441914 - DNA, 2339 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaaaaaaaacaaaaacccttgtatccatacttcactgtccgtcgtttacaacgttgtgactgggccctggggtacccaacttcgccttgcagacttccctttt

SEQ ID NO: 441915 - DNA, 1755 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcagtaagagttcaagtttcctaagctaaactatgaaatccaccagaaatatgtgcaaaattttgattactcagaaacttttttcctataattagaattgattctggcaaggggcaacatggcaaaaccctgcttctactaaaaaaaaataaaaaatcagccaggtgtggtggcacatgcctgtaatcccagctgctcgggagctgaggcacaggaatcacttgaacttgggaggcagaggttgcagtgagcctgggcaacagagtgagactctttctcaaaaaaga

SEQ ID NO: 441916 - DNA, 1388 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagtgagtacaaagccgcgggaccgtctaggcggcggcccaatgctcggggtttcacgggaacaagcgcggtcgggcggggttgcgggtagtcccgcgaggagcaacctctggagccatcgcgattgattcctcccatcccaagatggcttctgggttccactccttccccaaacaccacggataacacccctcccccttttttggaggctgactgatacctggacttctgggtcctcttccctccccgcccccgcattgcttcctcccttctccccacccctgaggcttccttatgtctgctccgaggtgtgggtccccgtcgcggttgggcgggaggaggcggcagggagctcccctccgtccggatagtggtaggtgcttcctgcggtggcatttctggcgaccccgagcatcgtagagggtctcgggatcgaaagtgcgcggggctgctttccgggcggggagaagctggcgtgggactagctggggcctgtgtctccttggctctctatttcagtgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggtaaatttgtcttttatatgcctgattatagta

SEQ ID NO: 441917 - DNA, 1587 bp, Homo sapiens
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagagtctcgctctcagtcaaaatctccaacgggaactcctgctcgtgtaaaatcggagagcaggtcaggatctcgtagtccatcaagggtttccaaacactctgaatcccattctcgatcaagatcaaaatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaa

SEQ ID NO: 441918 - DNA, 919 bp, Homo sapiens
  misc_feature (886)..(886): n is a, c, g, or t
  misc_feature (889)..(889): n is a, c, g, or t
  misc_feature (892)..(892): n is a, c, g, or t
  misc_feature (917)..(917): n is a, c, g, or t
agagacgcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatatggtgggggtggtggaagangcngcngcggtggaagtggaagtggtggcanac

SEQ ID NO: 441919 - DNA, 659 bp, Homo sapiens
accgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacggtgggtggc

SEQ ID NO: 441920 - DNA, 1953 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccagagcagaagaaaccaagctaccccaacatccaccgaccacacccaaccgaaaaaacaaaagaacaaccaaaaacaacaccaaccaaccaaaccaaagagcgaagaagatgaatacgacgaggacacggcccgaacaggaatgacgaaagacgtaagctgaagaggatacgagacgaatataagacacgaaaagccgaagagtacggagacacgtgagaagaaacgcagtgaatattgtatgacaataatactaattaaaaagtccccgagacgccgaacgagaaatagatagagaagacacaagatgcaaaggcagtgagaggcgaaattgaagggagaaaacgaggagcgagcgacccgaaacagagtcgagtggcctcagaaaaaggaataatagggcgaagtaagtgacagtgggggagtggaaattgaggaagtggagaggatgaatcaggtagacggaagaagaagcgcgccctaatgaacagagagtgaatcgaggagagggactggtggaaggacgatgataggaagccgcgcgccagtggaagtcgcgaggacgaaagaagtgcgtaggggtgcgcgaagggagcctaagaagcggagtctcggagagtttcaatggaagcagggttcccctctatgcgtgtatggagaacatggaatgtgagagcctcggaccgaaaggggctagcgaaagtgcaattgtcgagtgtgagtggagaaaggagctcgcaggtgggaatgggtgaaaaaaacgctccgaagtaagtgtcgacagtgcaggtgaaaagagtcaacaagcgatgcgaaggaatgaagagacatgaagctcagggagctgaaacgttaatgggtgagagagaacaatgctgaaaagcatgtgtgaacctccagggacgtaggatgaagataagaggcccagtgtgaaagaacctcgagaaagcggaggatcccggcaaggggggacgccatgctgataggacagctccccccgagatagtaacccattgcatagagatcgcg

SEQ ID NO: 441921 - DNA, 3355 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441922 - DNA, 3537 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatgtaggtggtgcgggggagcgggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctgaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441923 - DNA, 3486 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaaaaaagaacacaacaaacctgccacacacaagaaccagaccgcacacagaaacaccgggcttttttggggggcaaaagaggtaataagcggcgggtaatgtggcccccactttttaagagggaacgcggccccaggagatattcgcccact

SEQ ID NO: 441924 - DNA, 3449 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaaaaaaccaaaacaaaaacccgcgggcctcttttcggggggcggacaacacgggttcgcatgggcctggctcagggggtcccggccccttccggcccccggggaaatccggggcc

SEQ ID NO: 441925 - DNA, 2441 bp, Homo sapiens
cgcgcactccctttgcgtctcgggctcgcgcgcgttgccgcggcaccggaagtgactgagcttgcaagttcccctgtctcttcaggggaaactgaggccggcttgttcgggagagacggcgcgagcagtcagccagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441926 - DNA, 2570 bp, Homo sapiens
cgcgcactccctttgcgtctcgggctcgcgcgcgttgccgcggcaccggaagtgactgagcttgcaagttcccctgtctcttcaggggaaactgaggccggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441927 - DNA, 3493 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggtgccagatgccagttttagattctggctccaccactgacacagctgggtgaccttgatccagtccctggaccctcagaggcacagcttcttggcctgtaaatggggagagacagcctgcattgcagaattgttgggaggattaaaggacaaattgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441928 - DNA, 3151 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441929 - DNA, 3170 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441930 - DNA, 2428 bp, Homo sapiens
ttcttgcttatctccctacctagcggaggtgcaggttttatgagagatgttctatcccctcagagtatgcagaaaagcatcaagctgtggaaaataagtcatccattgaaggagctgaggtggaaggggacatgcaccatggactcaggaatgtcaagaatgcaactgtctataggctgggcctagggtgtggcaggcacttcactttaccactgagcaagagacctcctgagtttgccctggaaccccaccccctctctcattttgcatttctttgcaatttcaactcgtctgtgccagctcttgtaaaaggcaagggggtcaagtcaatagaggtcagataactggggtggggtcaggggaggtaaaggtggtgggttctcttgagctagctgactagacttgaaagccattctgtaaatgaactctctagggggataaatgattaaatagttcctgttggtttgtgcagtgacctctcctgttccctcctgctttgattctcttttggggcaaatatttgttcagctgattacaggagggacaggattccagtactgcagacacaccctctgaggcatctccaagtagggattgaggctgcttgcccactttgcctgactattgtctttggccagtggtcctaataccaggtgggttgttgccagctataaacaaaaggcagtctgggagaggtgcctggtctgctagccagcctctgcagaaggctacccctaccagagaattgccagctgcccagtggtgcatatgaaagaggtcttagacacagcaactctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441931 - DNA, 2866 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagactgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441932 - DNA, 2383 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaaccttgttccagctctttgaaatagtctgtgtgaaggtgaaagtgcagttcagtaataaactgtgtttactcagtgaa

SEQ ID NO: 441933 - DNA, 1312 bp, Homo sapiens
ataaaagctcgtttataaagcaggctggtacggtcggaatcccgggatatcgcaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441934 - DNA, 3336 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441935 - DNA, 3622 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatgtaggtggtgcgggggagcgggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctggtacctggagggggaatggaatttttagggtaaatggcatgcatattaattatttttttttcctgactctttctctcccttcagaaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441936 - DNA, 3538 bp, Homo sapiens
  misc_feature (3349)..(3349): n is a, c, g, or t
  misc_feature (3352)..(3352): n is a, c, g, or t
  misc_feature (3354)..(3354): n is a, c, g, or t
  misc_feature (3366)..(3366): n is a, c, g, or t
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaaaaacacaaaacanaananacacaacacaanaacaaaacgtgtggtgggccgcgcacgaggggccccacccaagagagctcacctacaacccacccaccataggggcagggggccccaaaaggaaagggaacagaggggcagaaccgagggccacaaggaggcacgcggggaagaaaagagagagggaacacgccacaaaaaa

SEQ ID NO: 441937 - DNA, 2389 bp, Homo sapiens
  misc_feature (9)..(9): n is a, c, g, or t
  misc_feature (22)..(22): n is a, c, g, or t
ccggggaanaacaacataggcnggacgaggctgggtgtgctgaggccggcttgttcgggagagacggcgcgagcagtcagccagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441938 - DNA, 3326 bp, Homo sapiens
  misc_feature (1021)..(1021): n is a, c, g, or t
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggcctggatgaacgctagcgccacctccttgcgcctgtctgatactataatgcggcgggtcatcatcgcgtgcgtcctgagtcaagggcgtattggtantattctattgggtttgggtgtctgataatagatgcattaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441939 - DNA, 2537 bp, Homo sapiens
  misc_feature (9)..(9): n is a, c, g, or t
  misc_feature (22)..(22): n is a, c, g, or t
ccggggaanaacaacataggcnggacgaggctgggtgtgctgaggccggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagctctttctctcccttcagaaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441940 - DNA, 2543 bp, Homo sapiens
cgcgcactccctttgcgtctcgggctcgcgcgcgttgccgcggcaccggaagtgactgagcttgcaagttcccctgtctcttcaggggaaactgaggccggcttgttcgggagagacggcgcgagcagtcagccaggtaggccggcagccaggtaggccggcccgggtccgcggcgcggaactcggccgcgaagagctcttgcgtctggaagctaccggctctttctctcccttcagaaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441941 - DNA, 2407 bp, Homo sapiens
cccgaagatgtacgagggccggcaccgggttgttacttgcaagtcgagcgggtctggggatacatggtacatatacatggacctagacctcatcaattttgaaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441942 - DNA, 2962 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggagggtcctggctcctgaggggcatctgcccctcccccaacccccaccccacacttgttccagctctttgaaatagtctgtgtgaaggtgaaagtgcagttcagtaataaactgtgtttactcagtgaa

SEQ ID NO: 441943 - DNA, 2498 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgatgggagaagactgcgcagtcttctcccatcaggttatctaactcagactactactctgtcttcatctaaagtgggacagtcatactcttcatcatagccatcatactatgcctctt

SEQ ID NO: 441944 - DNA, 2115 bp, Homo sapiens
tgattggctgcgctggggcggaccgccgggggcgaggcccctcctctcaggaaggtctagggggcgcccccgggggagggcggttgcctagcaacggggcggtggctcggcgggtacccggcctagtgagctcgagaagccgctaggccgcagccggcccaccctgggctccggagaggtgcagcccccggccccggagccctcccgggggcgccagaaagccactttgggcctgtccccaggaaaacgtggtctcagctgtggggccgtcgagcaggcctcgacccctcttcctgacctgaggagaggcccagcgcctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacaccttgttccagctctttgaaatagtctgtgtgaaggtgaaagtgcagttcagtaataaactgtgtttactcagtgaa

SEQ ID NO: 441945 - DNA, 784 bp, Homo sapiens
atgtctcatgacttctgtcaccagactcagagacggaaccagagacgggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctcaaaaaacacaaacacacacacacacaccaccaccacacgtggagccaccatggaccccacgaaaacagcacgctccacacacaacagagttaagcccacggggcgcccaacacgacacagagacaccacggcggcaccaaggggaccccacagagaaacacccggggcacagacaccaaggagaggagagatcaccagccgcacagtaaccaaacgccccgtgccgcaacccgcagacgtcctggacaccagcacacgcagtgcacatctggacaggccaaaggcggaccgtctaaaggagactccgaggacgcccacccaaacaatagccgc

SEQ ID NO: 441946 - DNA, 347 bp, Homo sapiens
cttctctcctctgtgtcgaccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctca

SEQ ID NO: 441947 - DNA, 384 bp, Homo sapiens
cttctctcctctgtgtcgaccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctcaaaaaaaagtcgacgcggccgcgaatttagtagtagta

SEQ ID NO: 441948 - DNA, 489 bp, Homo sapiens
atgtctcatgacttctgtcaccagactcagagacggaaccagagacgggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctcaaaaaaaagtcgacgcggccgcgaatttagtagtagta

SEQ ID NO: 441949 - DNA, 306 bp, Homo sapiens
gcagccgcctactactactaaatccccccccggtcgacccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctcaaaaaaaagtcgacgcggccgcgaatttagtagtagta

SEQ ID NO: 441950 - DNA, 452 bp, Homo sapiens
atgtctcatgacttctgtcaccagactcagagacggaaccagagacgggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctca

SEQ ID NO: 441951 - DNA, 451 bp, Homo sapiens
tacaagagaagagacgagatgtacagagaagacggaaccagagacgggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctca

SEQ ID NO: 441952 - DNA, 764 bp, Homo sapiens
atgtctcatgacttctgtcaccagactcagagacggaaccagagacgggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctcaaaaaaaaaaaaaaaaaaaaaaaaaaaaaaaaaaaaaaaaaaaaaaccgccggcggggcgtactagttggcggggcggcggaggagaaggagatgagcaagagaaccgggcgcacgagctgcgacacactgtgcgtgctccggcgacccagtttttcttgtgggccaacgggggtcgacacccgccgggcggccccataaaggagggcggcggtaaaatgcgcagacaaccgcggtgtcctcttggttatagcttcctgcgcacacacgacaacagcaagaacgcaccacacaacaaggtatacacaagccgg

SEQ ID NO: 441953 - DNA, 478 bp, Homo sapiens
actgtcagttcatttctgtgctcagtggggtagctttgttttttgtgtctcctgaacagatctccagtctatgtgctgaagaagcagcagcccaagagcagacaggtcaggtggaggagtgcctcaaggtcaacctgctcaagatcaaaacagaattgtgtaaaaaggtaaccaccgtcaccttcttttcctcacttcatttctttttttttttttctcttcttccttttaatgctgtagtctgcctaccttggtaataaaaccaaaaatctcaaccttctgcccagcactcttttcttgctgttccttcttaccaaactttcatttgattttgactgctcatctcctataatgtgaatattcttttcttttctttgagacggagtctcgctctgttgcccaggctggagctctgcagtgagccgagattgcaccactgcactccagcctaggcgacagagcgagactcagtctcaaa

SEQ ID NO: 441954 - DNA, 2171 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441955 - DNA, 2519 bp, Homo sapiens
agagtcaggggagagaggaggccacaagaaccagaaaactgccctaaaagaacgttcagaaggaatcaggccggcagtccttggaaagaaaaatctagaaattcaataaaacttcatgagtgtgccaggagaatgtacgggtaatctgattcggaacagaaacatttcacctctgagttggaagacctcgtaagttaatggtcacagtgagttggatattgtatttctttttcagtgttctcaaaagtgtctgttatggggaaggttgctgatgtccccttgatttttctgaggactccttagagtattggagtctgcacaaaaccccgcagagtagaaagattcctgaggacctccagaagtactcgttaacaagtcatattgctgattaaaaacagtgtagtgagagctcagtaaatgtttattgaatagataaatccatggttgtagtcatgatcattgacataatatgctccctttaggaaggtggatatctaaaaatgtgtgaatcaggtggaatgttttgtcacatgctcactgctttctactctagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441956 - DNA, 2677 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggacgctcggcgtgtgcacaacacacatcacacacaacagcacacacaatggggaagcaaagccgaagataggtaacataacataaaatgtgcaggtcagaaactaaacaagagtcaagacagagccctcctcagtctaacttaatgttgtaattttgtttcatctccagcccaatcaaccgtttatagagttcaaagtattgtccctttcccccatcccaaaattaccctatgcaaacagtcccaccttagtcaagtatggtggtgatgctgaggggtgatagcttaaaatggaatgttacctatcgtcctagatttcactcaatggaggatatacactccccttccctgttacaagcata

SEQ ID NO: 441957 - DNA, 1650 bp, Homo sapiens
cgttcgagtctcagctacccctggattgggactcacgcattctgatgtgatagctaaggacatatctctgttgttccaggttgctccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441958 - DNA, 1423 bp, Homo sapiens
aatgtattgattatgagtttggagttacccaagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441959 - DNA, 1831 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441960 - DNA, 1500 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441961 - DNA, 1059 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgaggtgggatttgcgtgcaaaactggttacgcacagagctgctcagagaagtttccactggagaaaagttgtttactttctctcccttcagccgtgaatgatctggtgaattgaaggccatcttctaggctctccatggtctgcattcctgttctttgtaacactgaattcaacttggcattagtcctgacactctaaagcgttgttccatatttctctgttgaacaagggtgttctttcattatagctctctgtaaatttgttcttcccttcttcttattctggatggtaaacccaagacctgccagaaagataaaagtgctttcagctgggcacggtggctcacgcctgtaatcccaacactttgggaggccaaggagggtggatcatctgaggtcaggagttcaagaccagcctggctaacatggagaaatctgtctctactaaaaatacaaaaaattagccaggcgtggtggcgtgcaccagtaatctcagctactcaggaggctgaggcaggagaatcacttgaacccgggaggcggaggttgcagtgagctgagatcatgccactgcaccccagcctgggcgacagaggaagactctgtctcaaaa

SEQ ID NO: 441962 - DNA, 347 bp, Homo sapiens
gggctaaggggccagatcaaaagcaggcattttgttttttcttgttctttttgtttttttcttgttcttgtggttgttgttgtttgttttttttttcatgtcctgcttttgtagaaaagcttcgttttctgatcagcccatgtatcctccctttgtcacatgcagcgcctgtcttcagactgtgaagaccagatccgaatcattatccaggagtccgccctggactaccgcctggatcctcagctccagctgcactgctcagacgaggtgggatttgcgtgcaaaactggttacgcacagagctgctcagagaagtttccactggagaaaagttgtttactttctct

SEQ ID NO: 441963 - DNA, 2403 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttaaaaaaaacaacaaacaaaacaaaaacaaagaaaaaggggggggcgcgcaaaaggaaccccacaggggggcaaaggtatcccgggacccgagtttcggggtaccaagggtgggccccaaagtggggcgccgaacttaaacgccaaggcctgggccagtcgttaacaccagcgctgccactggggcacaccgggaaggcggggagacctgggggaagggaacccaatccggag

SEQ ID NO: 441964 - DNA, 2052 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441965 - DNA, 1499 bp, Homo sapiens
gagttttctttgtttttccattggggggttttcttaaaaaagcctttgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441966 - DNA, 1790 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441967 - DNA, 1132 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgtt

SEQ ID NO: 441968 - DNA, 366 bp, Homo sapiens
  misc_feature (66)..(66): n is a, c, g, or t
  misc_feature (71)..(71): n is a, c, g, or t
tacaatcgagcggtaccggactgagatgatggaccagagctagactacaccctcatgagggtctgnaagcngatgataaagaggttctgtccggaagcagattctaaaaccatgttgcagtgcttgaagcaaaataaaaacagtgaattgatggatcccaaatgcaaacagatgataaccaagcgccagatcacccagaacacaggtaagatcttggcttggctctcctggccccgtggagtatctgaaaaggaattcagtggctgtagagtgacctgctcaaactcccagggctttgttgcctgggaattttaagggaggagtctgagtgtaagcagggccttcctcctttgaggagcatccaga

SEQ ID NO: 441969 - DNA, 1357 bp, Homo sapiens
  misc_feature (30)..(30): n is a, c, g, or t
  misc_feature (34)..(34): n is a, c, g, or t
  misc_feature (40)..(40): n is a, c, g, or t
  misc_feature (72)..(73): n is a, c, g, or t
gcctcctactccctccacaccccctcaccncccnccccgnccgaaactacggctaggtacgaggctgggtgnngccaacaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcagacgaactgggtttacggtgtttggcagggagtggtggccggaataaccttggtgtggacccctgatgtgctaaaggggtaactcatgtaagccgggagggggtactaagaagttctgcgcttcttacggagatgcgagattgtacgaaaaacgtgtgttacacgagtttgtaacaccaatgagagtgatgctgtcacatgctgaagaaagagagttattatggaggggaagagcatgtacttatggtagtagatcggacatctgtaggtccttacaaacagtctgtggggtgtgcattctttcttctgcgtacttcacttatga

SEQ ID NO: 441970 - DNA, 1033 bp, Homo sapiens
  misc_feature (935)..(935): n is a, c, g, or t
  misc_feature (972)..(972): n is a, c, g, or t
  misc_feature (974)..(975): n is a, c, g, or t
tggctagtacgagccgggtgtgtaatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtggtgtacattggcggtaaagggagtttgggaatgtncacgggattgggttgggaaaaaggggggttggaagangnnagggagggggggaagtggcaggaagttaaggggtgagaccaggaagggagagggtgga

SEQ ID NO: 441971 - DNA, 716 bp, Homo sapiens
cggacgcgtgggtccggacgcgtgggtcgacccacgcgtacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441972 - DNA, 997 bp, Homo sapiens
  misc_feature (855)..(855): n is a, c, g, or t
  misc_feature (870)..(871): n is a, c, g, or t
  misc_feature (890)..(890): n is a, c, g, or t
  misc_feature (895)..(895): n is a, c, g, or t
tggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtgcggtaatncggggcttggtcacnngtccccgcgatcggggtgnggaanaaagggggtcgcccaacgtagggggggggggcgcaagaccggaggtacggaaaccccccagaagagagttggtattttgtcctgttacgtcaatgccttatc

SEQ ID NO: 441973 - DNA, 1039 bp, Homo sapiens
  misc_feature (30)..(30): n is a, c, g, or t
  misc_feature (34)..(34): n is a, c, g, or t
  misc_feature (40)..(40): n is a, c, g, or t
  misc_feature (72)..(73): n is a, c, g, or t
  misc_feature (875)..(875): n is a, c, g, or t
  misc_feature (882)..(882): n is a, c, g, or t
  misc_feature (928)..(928): n is a, c, g, or t
  misc_feature (950)..(950): n is a, c, g, or t
  misc_feature (954)..(954): n is a, c, g, or t
  misc_feature (959)..(960): n is a, c, g, or t
  misc_feature (964)..(964): n is a, c, g, or t
  misc_feature (966)..(967): n is a, c, g, or t
  misc_feature (972)..(972): n is a, c, g, or t
  misc_feature (1037)..(1039): n is a, c, g, or t
gcctcctactccctccacaccccctcaccncccnccccgnccgaaactacggctaggtacgaggctgggtgnngccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaacccgaggatntaagcancagtggtgtacattggcggacagcgggctgggaggctcaccgggtnggttggtgaaaaaggggggtcngccnaaagnnaggngnnggggngcaaggcaggaagaatggagaaccccagaagttaatgtgtggagtgtgtgttcgtgtgttggttnnn

SEQ ID NO: 441974 - DNA, 240 bp, Homo sapiens
  misc_feature (18)..(18): n is a, c, g, or t
  misc_feature (21)..(21): n is a, c, g, or t
aaaaaaaaaaaaaaaaanatncttttcctcccccaccaaaaagggttaaaggaatatttttttgggggtacccccaaaaagctgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441975 - DNA, 1011 bp, Homo sapiens
  misc_feature (880)..(880): n is a, c, g, or t
  misc_feature (920)..(921): n is a, c, g, or t
  misc_feature (924)..(924): n is a, c, g, or t
  misc_feature (931)..(931): n is a, c, g, or t
  misc_feature (933)..(933): n is a, c, g, or t
  misc_feature (944)..(944): n is a, c, g, or t
cggcgccttataggggttacgttacgtggtgcacttggctcttatcaattgggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagcctggagncctttgtgccaatggttccaccgcgatctgggtcggtgcnnaanaaacggncngctccggccanaactggtaagtctgacgccgggccgctaatatgccccgcacaggttcaaaccggagtaacgccacga

SEQ ID NO: 441976 - DNA, 843 bp, Homo sapiens
  misc_feature (802)..(803): n is a, c, g, or t
accacatagaatttctttaaattgtgggctttattttgactagtgttttaaatccaataaatgcctctattgtttgagtaaattgttcacttttagagtctggctgtaaatggctctttgctgctgctcttcacttctggccggagttcttcaagcttactagtgccccaaatagtcatttaacaagcacctatgtgttggagtgggtaaacaagtctgtgtattatgtgaagtaacaatgtcctttatctactaataagaccaaggcaaagagtacatgtagatttatttaaagtgctcttaatatcttagtatgaaaattttgtcagattagcctcttgtttatttacacaacattttaaaataatttgaatatattttaattaagatcattgaaacaaaaacaagacatcgaaaatttatttgttccaaactggattagaagtctacttacctaaaagagaaatgaatttgaaatattaggagggagaggaaggtgatgtataccatcccttctagtactggcagaaatagataagcttttcctccccccccattagttaatgtaatggatatgaaatgtacctttgctaaaacgtgttatgcatgtctcttgaagtgaatttagtttatgtgctttttttttttaacttgtgtttagtttgtttagtgttcacaaaactttatgctataagctacttaaagaactagcatatgttaggaatacagttatatctattatctagacagtagcttttaaaaagtaggaggtggaggttgctgtgaaccaagattgcgcccnngcacaacaagagtgaaactccatccatctcaaaaaaaaaa

SEQ ID NO: 441977 - DNA, 278 bp, Homo sapiens
ctaaattgcggccgcgtcgaccttcttcagagactctggcatctcgggtggaggagggcgaggagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441978 - DNA, 1350 bp, Homo sapiens
taaccataggctaggtacgaggctgggtggtgcgcaacaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441979 - DNA, 1391 bp, Homo sapiens
  misc_feature (30)..(30): n is a, c, g, or t
  misc_feature (34)..(34): n is a, c, g, or t
  misc_feature (40)..(40): n is a, c, g, or t
  misc_feature (72)..(73): n is a, c, g, or t
gcctcctactccctccacaccccctcaccncccnccccgnccgaaactacggctaggtacgaggctgggtgnngccaacaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441980 - DNA, 1347 bp, Homo sapiens
  misc_feature (10)..(10): n is a, c, g, or t
  misc_feature (14)..(14): n is a, c, g, or t
  misc_feature (16)..(16): n is a, c, g, or t
  misc_feature (18)..(18): n is a, c, g, or t
aggctaggtngagncngnggtaatcggcagaggccaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441981 - DNA, 1387 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaaacaaaaaaaaagggggcccccaagcaccccgagggc

SEQ ID NO: 441982 - DNA, 1987 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaaaaaaaaaaaaaatatatatatatatatatatatgaagctgatagttgaattatgttgattcagggacaagatagcattgcatagtaacttccagtaggatcaaatattttgagagtggttaaaacgccaaggaatcctgattttatgaaattatgccttctgataggtgcaacaaaattgaacagaagagtaacagcttaactaaacctccattgtgtgaaagttttatgaaatgttttgactttttttttttttttccctagagaacagggttctttgctttgtcgcccaggctggagtacagcctttgaactcctgggctcaagcgatcctcctgcctcagcctcccagttagctgacacaattgggatgtgccactacttgctcctgttttttcatagacgggtcctgctgttgctcaggctggtctcggattcctggcctcaagcaactttcctgccccagctcctaaagcg

SEQ ID NO: 441983 - DNA, 1384 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgacacacaacacacaccaacacaccacaacaccccg

SEQ ID NO: 441984 - DNA, 1626 bp, Homo sapiens
  misc_feature (15)..(15): n is a, c, g, or t
  misc_feature (25)..(25): n is a, c, g, or t
  misc_feature (1353)..(1353): n is a, c, g, or t
  misc_feature (1360)..(1360): n is a, c, g, or t
  misc_feature (1363)..(1364): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaacnacacacncannaaacaaacaagcaacaaaaaagaccaaaacgaccaaaccaagaacaagacgaacggacgaagacaggccgaacgaacaagcaagcagcgccgtgagaccaacaagaaaacaagcacgagtatgggcagacgcaacgcacctccacgaaaacgaaagggcaaagacggggcggcaccacacaacaagaggggggaggaaagcagccccgggtagaagcaggactacacgggagataaacgaacgcgcgggataacacagaagt

SEQ ID NO: 441985 - DNA, 1367 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaggagagttcgattccggtgattaaccatcttctggaaaaaaaaaccgggcctttgggcggaaagg

SEQ ID NO: 441986 - DNA, 1301 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441987 - DNA, 987 bp, Homo sapiens
  misc_feature (15)..(15): n is a, c, g, or t
  misc_feature (25)..(25): n is a, c, g, or t
  misc_feature (961)..(962): n is a, c, g, or t
  misc_feature (966)..(966): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaanntgancgggatcctctagatcactct

SEQ ID NO: 441988 - DNA, 1034 bp, Homo sapiens
  misc_feature (15)..(15): n is a, c, g, or t
  misc_feature (25)..(25): n is a, c, g, or t
  misc_feature (936)..(936): n is a, c, g, or t
  misc_feature (973)..(973): n is a, c, g, or t
  misc_feature (975)..(976): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtggtgtacattggcggtaaagggagtttgggaatgtncacgggattgggttgggaaaaaggggggttggaagangnnagggagggggggaagtggcaggaagttaaggggtgagaccaggaagggagagggtgga

SEQ ID NO: 441989 - DNA, 1037 bp, Homo sapiens
  misc_feature (15)..(15): n is a, c, g, or t
  misc_feature (25)..(25): n is a, c, g, or t
  misc_feature (906)..(906): n is a, c, g, or t
  misc_feature (946)..(947): n is a, c, g, or t
  misc_feature (950)..(950): n is a, c, g, or t
  misc_feature (957)..(957): n is a, c, g, or t
  misc_feature (959)..(959): n is a, c, g, or t
  misc_feature (970)..(970): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagcctggagncctttgtgccaatggttccaccgcgatctgggtcggtgcnnaanaaacggncngctccggccanaactggtaagtctgacgccgggccgctaatatgccccgcacaggttcaaaccggagtaacgccacga

SEQ ID NO: 441990 - DNA, 959 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagcagctggagtcttttgtgcattgtttctcacccccagatgacgaagtaataaagcgttgag

SEQ ID NO: 441991 - DNA, 1565 bp, Homo sapiens
  misc_feature (2)..(2): n is a, c, g, or t
anagggccgcctactactactactactactatgctgcgagaagacgacagaatgggagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441992 - DNA, 1339 bp, Homo sapiens
gggggcggcaaactaatggctaggtacgaggcctgggtgggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441993 - DNA, 1302 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441994 - DNA, 1154 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggagtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441995 - DNA, 1268 bp, Homo sapiens
tggctagtacgagccgggtgtgtaatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 441996 - DNA, 1060 bp, Homo sapiens
  misc_feature (30)..(30): n is a, c, g, or t
  misc_feature (34)..(34): n is a, c, g, or t
  misc_feature (40)..(40): n is a, c, g, or t
  misc_feature (72)..(73): n is a, c, g, or t
  misc_feature (980)..(980): n is a, c, g, or t
  misc_feature (992)..(992): n is a, c, g, or t
  misc_feature (1014)..(1014): n is a, c, g, or t
  misc_feature (1016)..(1016): n is a, c, g, or t
  misc_feature (1021)..(1021): n is a, c, g, or t
  misc_feature (1025)..(1025): n is a, c, g, or t
gcctcctactccctccacaccccctcaccncccnccccgnccgaaactacggctaggtacgaggctgggtgnngccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtaccttggtgccggtcactagcggggcttgggcatggttccccccggggtcngggtccggtganaacaagggcggttctggccccnancggtngtgngggggccccaggcgcggggggtttcggggggaccc

SEQ ID NO: 441997 - DNA, 1161 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaaggtgagatcagaccctgcccaatacagtcgtgtggtctacttgtgggccgcccagcctttgaggcctggacccggcttggaggacagggaaggacgagtccagcccgctgcaccgtaggacggcgcccagttgcttgccctggggtatcggccttttccaccataggcgggtgtcagatccttggccttccctcaagggcgtggaagcgctgaggccctgtgtcccttcgtgacctccgtgtgcccgagggaagagaggccgtgactagctctttctccgccgtgagctcgcttggtcagcaaactaagtactgggtaaactctcctcccgaaactactgaccacccacagttctactaactatattacctgtcctttgatttgcccttagttttcttaaaaatagtcctttcctaagttttatatttgtcgacgccaggtcagtcatttttgcacttaattgtatatgagataactagatgtcctgttttcgtgcgactggaggaggcagcttgcagccctacataggcaatagaaaggagataattggtgggcgtccctttggtgtgattatctcttgggattcttggtggttgggcccagctttaacttagttgtgtgtgttttaaatcctagtgattactgataaacacggttacctgtaacatctttcctgtcaagctttcc

SEQ ID NO: 441998 - DNA, 659 bp, Homo sapiens
atattaaaatgcatggtgtgtcttctcttactacaagtacagttgtgaatttggctccgcgaagtattatgcactgtgtggctttggtggggtcttaagttgtggtctgacacacactgctgtggttcccctggatttagtgaaatgccgtatgcaggtttgtattgagatgacaacattgaaagtatctctcatgtgacttaactctaaataaaatcttaaatgagaatttgaagacatcacaactgctagaaacttcagtaggaaaccacatagaatttctttaaattgtgggctttattttgactagtgttttaaatccaataaatgcctctattgtttgagtaaattgttcacttttagagtctggctgtaaatggctctttgctgctgctcttcacttctggccggagttcttcaagcttactagtgccccaaatagtcatttaacaagcacctatgtgttggagtgggtaaacaagtctgtgtattatgtgaagtaacaatgtcctttatctactaataagaccaaggcaaagagtacatgtagatttatttaaagtgctcttaatatcttagtatgaaaattttgtcagattagcctcttgtttatttacacaacattttaaaataatttgaatatattttaattaagatca

SEQ ID NO: 441999 - DNA, 1461 bp, Homo sapiens
ctccaccaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaaacaaaaaaaaagggggcccccaagcaccccgagggc

SEQ ID NO: 442000 - DNA, 1076 bp, Homo sapiens
  misc_feature (15)..(15): n is a, c, g, or t
  misc_feature (25)..(25): n is a, c, g, or t
  misc_feature (913)..(913): n is a, c, g, or t
  misc_feature (978)..(978): n is a, c, g, or t
  misc_feature (994)..(994): n is a, c, g, or t
  misc_feature (998)..(998): n is a, c, g, or t
  misc_feature (1006)..(1006): n is a, c, g, or t
  misc_feature (1008)..(1008): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagggtgccggtcatgcngggctttgggcatgttccccgctgtctggtgtcggtgataagaagggggggctcggcccagaggntaggggggggggcccncaanggcccggncngggttagcgggggaaaccccccagagaagggcaacggggggaagttggcttcgtgcgctcgcacagtg

SEQ ID NO: 442001 - DNA, 812 bp, Homo sapiens
  misc_feature (10)..(10): n is a, c, g, or t
  misc_feature (14)..(14): n is a, c, g, or t
  misc_feature (16)..(16): n is a, c, g, or t
  misc_feature (18)..(18): n is a, c, g, or t
  misc_feature (743)..(743): n is a, c, g, or t
  misc_feature (763)..(763): n is a, c, g, or t
  misc_feature (769)..(769): n is a, c, g, or t
aggctaggtngagncngnggtaatcggcagaggccaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcgcttctacaaggggtggcccnctggtggaacgtcctacccngtgatngccgcttgactctgtgaccgttcagtgggtccacccagagtcc

SEQ ID NO: 442002 - DNA, 977 bp, Homo sapiens
tggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggacggggccttgggcaatggttcacccggggttctgggttctgggtggcacagaaagggggggtctgggcccaaagcggttaaggttagagaggtgcccacacaaaggccggggcagggtaacacgggtaacc

SEQ ID NO: 442003 - DNA, 769 bp, Homo sapiens
  misc_feature (17)..(17): n is a, c, g, or t
  misc_feature (19)..(20): n is a, c, g, or t
atccttaattaaattantnncccccccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagccgtaagtaaacacttaaaaatttatactatgaaagtacttattttaagtgaac

SEQ ID NO: 442004 - DNA, 1350 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 442005 - DNA, 1349 bp, Homo sapiens
tggctagtacgagccgggtgtgtaatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 442006 - DNA, 1352 bp, Homo sapiens
cggacgcgtgggtccggacgcgtgggtcgacccacgcgtcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 442007 - DNA, 1634 bp, Homo sapiens
  misc_feature (15)..(15): n is a, c, g, or t
  misc_feature (25)..(25): n is a, c, g, or t
  misc_feature (1396)..(1396): n is a, c, g, or t
  misc_feature (1399)..(1399): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaaaaaaaaaaaaaaaaaaaaaaaaaaaaaaaaaaaaaaaaaaaaaanaanaaaaaaaaaaaaaaaagaaaaaaaaaaaaaaaaagaagcaagaagccggaccgaacaaaaaaaaaccaaagtgagaaagaaagaaaaagagggagggggggcggggtggacgaatcataagaagagacgccggcgaggagcgcaggatgtgatacaccaacacgagggcgagaagggaagcgacgaccgagaaggggagcaaaatcaaaggaagtcggcggcgcttcgtggaaaa

SEQ ID NO: 442008 - DNA, 1416 bp, Homo sapiens
  misc_feature (15)..(15): n is a, c, g, or t
  misc_feature (25)..(25): n is a, c, g, or t
  misc_feature (1372)..(1372): n is a, c, g, or t
  misc_feature (1381)..(1381): n is a, c, g, or t
  misc_feature (1406)..(1406): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaaaaacaaaaaaaaaaaaaaatngggggtttntgtggggggggaaaagaggttttgnaatggccatg

SEQ ID NO: 442009 - DNA, 1586 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagtt

SEQ ID NO: 442010 - DNA, 1492 bp, Homo sapiens
  misc_feature (15)..(15): n is a, c, g, or t
  misc_feature (25)..(25): n is a, c, g, or t
  misc_feature (1371)..(1371): n is a, c, g, or t
  misc_feature (1374)..(1374): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaaaaaaaaaaaaaaaaaaaaanaanaaactgacctacaacctggatgagaaaaaaagactacatatcacacgaaggggcttaagatggcccgggcagaaccaacagaaaaaaaagcccgggtcccgccctctcccaatttggg

SEQ ID NO: 442011 - DNA, 1412 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatatacctgggtcatcttggctagggcaggagttcccattactggtggaataacccatcttctggaaaacaacaaaggggggggcaaattcctcagggcgagtaagaccactttgaaggcccagaaggtaaaaaaag

SEQ ID NO: 442012 - DNA, 1316 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcagacgaactgggtttacggtgtttggcagggagtggtggccggaataaccttggtgtggacccctgatgtgctaaaggggtaactcatgtaagccgggagggggtactaagaagttctgcgcttcttacggagatgcgagattgtacgaaaaacgtgtgttacacgagtttgtaacaccaatgagagtgatgctgtcacatgctgaagaaagagagttattatggaggggaagagcatgtacttatggtagtagatcggacatctgtaggtccttacaaacagtctgtggggtgtgcattctttcttctgcgtacttcacttatga

SEQ ID NO: 442013 - DNA, 1031 bp, Homo sapiens
  misc_feature (15)..(15): n is a, c, g, or t
  misc_feature (25)..(25): n is a, c, g, or t
  misc_feature (951)..(951): n is a, c, g, or t
  misc_feature (963)..(963): n is a, c, g, or t
  misc_feature (985)..(985): n is a, c, g, or t
  misc_feature (987)..(987): n is a, c, g, or t
  misc_feature (992)..(992): n is a, c, g, or t
  misc_feature (996)..(996): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtaccttggtgccggtcactagcggggcttgggcatggttccccccggggtcngggtccggtganaacaagggcggttctggccccnancggtngtgngggggccccaggcgcggggggtttcggggggaccc

SEQ ID NO: 442014 - DNA, 1051 bp, Homo sapiens
  misc_feature (15)..(15): n is a, c, g, or t
  misc_feature (25)..(25): n is a, c, g, or t
  misc_feature (909)..(909): n is a, c, g, or t
  misc_feature (924)..(925): n is a, c, g, or t
  misc_feature (944)..(944): n is a, c, g, or t
  misc_feature (949)..(949): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtgcggtaatncggggcttggtcacnngtccccgcgatcggggtgnggaanaaagggggtcgcccaacgtagggggggggggcgcaagaccggaggtacggaaaccccccagaagagagttggtattttgtcctgttacgtcaatgccttatc

SEQ ID NO: 442015 - DNA, 1379 bp, Homo sapiens
  misc_feature (30)..(30): n is a, c, g, or t
  misc_feature (34)..(34): n is a, c, g, or t
  misc_feature (40)..(40): n is a, c, g, or t
  misc_feature (72)..(73): n is a, c, g, or t
gcctcctactccctccacaccccctcaccncccnccccgnccgaaactacggctaggtacgaggctgggtgnngccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 442016 - DNA, 1296 bp, Homo sapiens
tggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 442017 - DNA, 1457 bp, Homo sapiens
  misc_feature (15)..(15): n is a, c, g, or t
  misc_feature (25)..(25): n is a, c, g, or t
taggctagtgcgagncccgtatttnatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtttgttttgcatgctggactagagcatattgaagcatgactgactgttaagttataagatatagtcatctaacaagctgtgtggaaacctaactgtccaggaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 442018 - DNA, 755 bp, Homo sapiens
cggacgcgtgggtccggacgcgtgggtcgacccacgcgtctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 442019 - DNA, 1393 bp, Homo sapiens
tggctagtacgagccgggtgtgtaatcggcacgaggcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgaatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaaaaaaaaaaaaaatatatatatatatatatatatgaagctgatagttgaattatgttgattcagggacaagatagcattgcatagtaacttccagtaggatcaaatattttgagagtggttaaaacgccaaggaatcctgattttatgaaattatgccttctgataggtgcaacaaaattgaacagaagagtaacagcttaactaaacctccattgtgtgaaagttttatgaaatgttttgactttttttttttttttccctagagaacagggttctttgctttgtcgcccaggctggagtacagcctttgaactcctgggctcaagcgatcctcctgcctcagcctcccagttagctgacacaattgggatgtgccactacttgctcctgttttttcatagacgggtcctgctgttgctcaggctggtctcggattcctggcctcaagcaactttcctgccccagctcctaaagcg

SEQ ID NO: 442020 - DNA, 1583 bp, Homo sapiens
tggctagtacgagccgggtgtgtaatcggcacgaggcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 442021 - DNA, 1123 bp, Homo sapiens
tcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactctggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcc

SEQ ID NO: 442022 - DNA, 954 bp, Homo sapiens
gtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagaaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagaaacatctctaatttttttcttcagatcaagtcagcatttggggtcgggatttgggcagggaactctggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcc

SEQ ID NO: 442023 - DNA, 1193 bp, Homo sapiens
tcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactctggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcccacaagtgtattatttttgcatgtatttattttagagggcagtatttttgaaatcattagtgattctcat

SEQ ID NO: 442024 - DNA, 870 bp, Homo sapiens
gtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagaaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggttttttccctccataaatcaaaaattaccttatgtaaaccaaaaattagttggtatttatggtcatgatcttaattctcaagtttagcttaatcttgtatttcattgtttgtcttctaatatgacagcttaaattcagattt

SEQ ID NO: 442025 - DNA, 1209 bp, Homo sapiens
agcgggccatgttgttccctccgcgctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgagacactcttgcactcctgtaatgagcctggcactgtgatgaaacacttttcccgtgtcgtttgagtgcatcttctcaacaaccctaggagggttcttgaagcttttgagattaacaatggcaggaaaatcatcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcaggtcaggagcgattccgaagcctgaggacaccattttacagaggttctgactgctgcctgcttacttttagtgtcgatgattcacaaagcttccagaacttaagtaactggaagaaagaattcatatattatgcagatgtgaaagagcctgagagctttccttttgtgattctgggtaacaagattgacataagcgaacggcaggtgtctacagaagaagcccaagcttggtgcagggacaacggcgactatccttattttgaaacaagtgcaaaagatgccacaaatgtggcagcagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacacatccactcttggaggaatatatttactcaataatggcaccttacatttataaattgtaacagttgtctaataacgtttctttaatttaaatatgtaagttgcagagctaataaatgaaatgaccaagactttaattataataaaaataagaaacttgactattcta

SEQ ID NO: 442026 - DNA, 1377 bp, Homo sapiens
agcgggccatgttgttccctccgcgctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgagacactcttgcactcctgtaatgagcctggcactgtgatgaaacacttttcccgtgtcgtttgagtgcatcttctcaacaaccctaggagggttcttgaagcttttgagattaacaatggcaggaaaatcatcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcaggtcaggagcgattccgaagcctgaggacaccattttacagaggttctgactgctgcctgcttacttttagtgtcgatgattcacaaagcttccagaacttaagtaactggaagaaagaattcatatattatgcagatgtgaaagagcctgagagctttccttttgtgattctgggtaacaagattgacataagcgaacggcaggtgtctacagaagaagcccaagcttggtgcagggacaacggcgactatccttattttgaaacaagtgcaaaagatgccacaaatgtggcagcagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacacatccactcttggaggaatatatttactcaataatggcaccttacatttataaattgtaacagttgtctaataacgtttctttaatttaaatatgtaagttgcagagctaataaatgaaatgaccaagactttaattataataaaaataagaaacttgactattctagaagttatacttggattttttcctgggaaaatggagaactactttttatatgtgtatgtttttatgcaattagcattgtattcttggttcagggaaatactttcctaaagcaataatgttagatattaaagattaaaatctaatgtatttgcaatgcattgttaattt

SEQ ID NO: 442027 - DNA, 1288 bp, Homo sapiens
agcgggccatgttgttccctccgcgctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgagggttcttgaagcttttgagattaacaatggcaggaaaatcatcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcaggtcaggagcgattccgaagcctgaggacaccattttacagaggttctgactgctgcctgcttacttttagtgtcgatgattcacaaagcttccagaacttaagtaactggaagaaagaattcatatattatgcagatgtgaaagagcctgagagctttccttttgtgattctgggtaacaagattgacataagcgaacggcaggtgtctacagaagaagcccaagcttggtgcagggacaacggcgactatccttattttgaaacaagtgcaaaagatgccacaaatgtggcagcagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacacatccactcttggaggaatatatttactcaataatggcaccttacatttataaattgtaacagttgtctaataacgtttctttaatttaaatatgtaagttgcagagctaataaatgaaatgaccaagactttaattataataaaaataagaaacttgactattctagaagttatacttggattttttcctgggaaaatggagaactactttttatatgtgtatgtttttatgcaattagcattgtattcttggttcagggaaatactttcctaaagcaataatgttagatattaaagattaaaatctaatgtatttgcaatgcattgttaattt

SEQ ID NO: 442028 - DNA, 3392 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaactta

SEQ ID NO: 442029 - DNA, 1470 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgacccca

SEQ ID NO: 442030 - DNA, 942 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccggaggatggggtgagggagcagtgccgaagagctatgagagggagccaagaggaaaggaagtcctcgacagagccaactaggaggagggcggcctcccaggctgccgaagaaggatccagcgtcagctaagtggaggcggggccgtgcccagtgcattgcaatgaggcctggagtgaggctgtggccaagccagcaagaccccataggccctgggactgccctctgcccaggtgcaggaggacacaggtcctggagtcagatagacccaggagtttctgtgtgaccagaagtacagtgatgaagagaaccttccagaaaagctcacagccttcaaagggggtgacctgcagaggccccacggtccgtttgacacactgctcccatctgaacataccaagcccactgctccgacatcctccctcactgctagaagttttcctggactccttgatcagggaagtataactcagtctgtgtgtgaggtttggggtgatggtctgtgtaccccgggaaactgtatgtccactttgtgggctagggcaggcctttttcctggtttcagaatcacaggtcccctgaatcagtggttcccacacccggttgcccatcagaactgcctgggacgctaaaaagcacacccatgcctgcccccaccctgtccttccacacccatgagccagaatcctggggcagggaatcagagctagtcactttgctactaactcagatgcag

SEQ ID NO: 442031 - DNA, 3414 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggccgcctctttgtctcctccaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaactta

SEQ ID NO: 442032 - DNA, 3475 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttaaaaaaaaaaacacacaacaactacaacaaacacacaaatcccaacaacacacaccagcgcgcacaccaccaacaaaaaccacc

SEQ ID NO: 442033 - DNA, 4135 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttactaaaaaaaaaaaaaaaaaaaaaaaaaaaaaaaaaaaaaaaaaaaaaaaaaaaaaaaaaaaaaaaaaaaaaaaaaaaaaaaaaaagaagggggggcgcgcgccccaagaatatctatctccccgcgggggggcccccaccgcggcgcccccccgtttttgtggaaaagagggggccccccataggggggggcttttaaagggggggcgggggcgcgtcgtttataaccaacgcgcgtggggcgcggggaacaaaccgtggtggtacggtgtagggctcttctggtaggtgggagcgcccccctccttcctgctggggggggggagacaactatggtgggcgcgcccacacctcactccgcggagtagtttcaagcccgccgcgcggaggaatatcattcaaaacctcttgcgggggtgtatatggcgtggtgacacccccccgcgatatcttatctccggggcggatcaaaaaaagattttgggcgccccaccgggtactattgtgtcttctcagcgaacaacttctttttccccccgcggccgtccgtgctattaataaatcccggtctacgcaagtcgactataccactactatcggcaacgagacaacatacgacgaacagcactcactcgctaggtgcaataaattgacataagtctcagtcaccagctacagagagtaagcgctagcaacacgccacaaccaaaccagctatgtcaacaaatcaatcgagcacacgca

SEQ ID NO: 442034 - DNA, 2604 bp, Homo sapiens
cgagtgaagtaatacaggcggaccggtttattcatccggggctgggttacttgagttactggcctggtcgtacaattccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaactta

SEQ ID NO: 442035 - DNA, 2203 bp, Homo sapiens
  misc_feature (15)..(15): n is a, c, g, or t
  misc_feature (32)..(32): n is a, c, g, or t
  misc_feature (87)..(87): n is a, c, g, or t
ccccccccccccccnggtgttttttaaaaagncccctttttggggttttccccccccctttttttaaacctttgggggggggggggncccaagcagaagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaactta

SEQ ID NO: 442036 - DNA, 2757 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaactta

SEQ ID NO: 442037 - DNA, 1139 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaactta

SEQ ID NO: 442038 - DNA, 167 bp, Homo sapiens
cagtgacactatatcctaccgagactttgtgaacatgatgctggggaaacggtcggctgtcctcaagttgtgagtacctccttcctcccttgggatctctgaaggcaaaatcattctgtgcagagaggcccctggctctgggcaccccagccattccccacctagta

SEQ ID NO: 442039 - DNA, 787 bp, Homo sapiens
gagtttctgtgtgaccagaagtacagtgatgaagagaaccttccagaaaagctcacagccttcaaaggtaagctggggcgggctgccctgcatttattcctgggggaggtgggctggcccctcatccttgcacacaggacccctcagccccacaggactaggctgtggccctgttttgtccagaatgcccttcttcctggagaaggcttggagacagggaccccctgagaggtggggagaggcccctccacctgcctccctgcccctgcgggccccgtcacccctcgcctgcagcccggtcctggccctgcccctctctctcccctcactgcccacggggctcaggctggttcccgtccgccgctgcccaggccccgtcactcccgggccccgcacacaatcagctctttgtgagcaagccttgcctctccccctccccagcagagcgtctcaggagcccctgcggagaatggacgtttgtgtcaccgcagtggggcaggggggcagagtttctgcccattgaaacccggcagcacgggatgaaaagaaagcagggcctgggagccggcgcggggagaggggcagcataaaggtccctctgtttggggccctggcgcttggttcccagccagcacctcgaaaggagaggagccgggcacatagggggcagcgcagacccaccttccctgccaggggaggcacttaggcgcaggagccctgggctgtcatggaaaatatcctggaggttgcattcccctccaaagtgtttgcagtgtgagcatcctcc

SEQ ID NO: 442040 - DNA, 496 bp, Homo sapiens
ggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttaaccaacgtcttgattggtgtattttggggctggttctgggctcagcaaattgcgaactagctaatatagtaagagattaaatgagcatgt

SEQ ID NO: 442041 - DNA, 679 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaacttattttttttatgaggccacctcttctggcttttgttttgtttccccgggggggggcccggtcccaataagcctttgtg

SEQ ID NO: 442042 - DNA, 731 bp, Homo sapiens
tggttttcttggactgcttggatgtaggcagcctgtctgttttccatccgctggctacaggactcccattcggtccccagctacagggctctggggacctcagggttccccctccaggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggagtcatgatgtttgaaggaaaagccaacgagagcagccccaagccagttggcccccctccagagagagacattgctagcctgccctgaggaccccgcctggactccccaagacataacacaacacataaagctcccatcccacgatcataggctgcccttggctgggaacgccactgtgaagttcctgctcctcatcaactcaggtgggagagggacataggaagggctgcgagcgggtagacgacacaaatgacatagagcagaagaaacaaaatgaatactgacagtgaaaggggcgcacctgggacagaggaacagcactggacaccaggcgaccacaacaaactatacgacaggaacaacagtacaagaaacaagagcagcaagggaaggaagcaagcaacacaacgaagggg

SEQ ID NO: 442043 - DNA, 3317 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaactta

SEQ ID NO: 442044 - DNA, 2441 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagctttacatcctcccatgttgtcctggcatgtgcagtatacacggtctaactcatctctccccagatctctcagaaccttgagcttgggaattgaactggggtcacctgtgtcctttcttatggactcgcaggattttagaaccctaatgcaccctggagggtagctgggccagacttctcatttcacaggtgaggagactggtgccccacagggattaagtgccttgcccaaggtcaggcttatctccagagggaggtgccctggactggggcccagatgttcagggaccctgcctacacctcatttccagtgtgggctgccttagttagttatgagaacagggaagggctgggaagagacagcctccaaggtcaacacttggagagggtttcacttgctctgaagaccctggtccaggattcgccctctcccatgccttcaagtcagcatcaggcttagggcaaagaccaggcctctgaagctgcctcttgtaattcatgcaggaagatgtcaaagtcagccccatcttggctgatcagggtgttcagccttaaccccacctgtgttctgaagtctcttaccctacctgctcaggactgagacagttattcactgaacatatttattaagcacttgctgtaggccaacagttaagaatccaataatgaaatggacagattcatggaacttagagtccaataggaaagtgagacccagacaatgacaatgagataaatgttaggaagggggaggtatggggtgacttccctgcagtcctgggggcctagatgggcccaagactgggtgagagtcttggcagagcctttgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatcattagatgtcctcacccctcctcactgcctctcctctctgggacaggctgggacctttgaggaagataaagccttccttgactacccatcatattcagtgtccctgttcctcactcagagaggaaggcagaaccagtcaggcttatttcagtaagttccacagttctacaagactgcaggaattctccttaagggaggagagcaagcaggtgtggccccagcttctggaaatggcagaagagagggttttctcattgaatgggggtgggggctcgtgtgtcctgggaaaccccatcagtcccttcatttcttgagactcaactcctgggaggagagggtctcaagagttgtccctggaaggagggcgggggcagtctgcatctatttcaggttgtggctcttggttctaggactcttacttctctggctaagggctcagcttcttgggacttcaaccatcttctttctgaaagaccaaatctaatgtaaccagtaacgtgaggactgccaagtatggctttgtccctatgactcagaggagggtttgtcgggcaaattcaggtggatgaagtatgtgtgtgcgtgtgcatgggagtgtgcgtggactgggatatcatctctacagcctgcaaataaaccagacaaactta

SEQ ID NO: 442045 - DNA, 1715 bp, Homo sapiens
gcccctcggtcccgcggcacacgcagctagccggagcccggaccaggcgcctgtgcctcctcctcgtccctcgccgcgtccgcgaagcctggagccggcgggagccccgcgctcgccatgtcgggcgagctcagcaacaggttccaaggagggaaggcgttcggcttgctcaaagcccggcaggagaggaggctggccgagatcaaccgggagtttctgtgtgaccagaagtacagtgatgaagagaaccttccagaaaagctcacagccttcaaagagaagtacatggagtttgacctgaacaatgaaggcgagattgacctgatgtctttaaagaggatgatggagaagcttggtgtccccaagacccacctggagatgaagaagatgatctcagaggtgacaggaggggtcagtgacactatatcctaccgagactttgtgaacatgatgctggggaaacggtcggctgtcctcaagttagtcatgatgtttgaaggaaaagccaacgagagcagccccaagccagttggcccccctccagagagagacattgctagcctgccctgaggaccccgcctggactccccagccttcccaccccatacctccctcccgatcttgctgcccttcttgacacactgtgatctctctctctctcatttgtttggtcattgagggtttgtttgtgttttcatcaatgtctttgtaaagcacaaattatctgccttaaaggggctctgggtcggggaatcctgagccttgggtcccctccctctcttcttccctccttccccgctccctgtgcagaagggctgatatcaaaccaaaaactagagggggcagggccagggcagggaggcttccagcctgtgttcccctcacttggaggaaccagcactctccatcctttcagaaagtctccaagccaagttcaggctcactgacctggctctgacgaggaccccaggccactctgagaagaccttggagtagggacaaggctgcagggcctctttcgggtttccttggacagtgccatggttccagtgctctggtgtcacccaggacacagccactcggggccccgctgccccagctgatccccactcattccacacctcttctcatcctcagtgatgtgaaggtgggaaggaaaggagcttggcattgggagcccttcaagaaggtaccagaaggaaccctccagtcctgctctctggccacacctgtgcaggcagctgagaggcagcgtgcagccctactgtcccttactggggcagcagagggcttcggaggcagaagtgaggcctggggtttggggggaaaggtcagctcagtgctgttccaccttttagggaggatactgaggggaccaggatgggagaatgaggagtaaaatgctcacggcaaagtcagcagcactggtaagccaagactgagaaatacaaggttgcttgtctgaccccaatctgcttgaaacctgactctgcttctctcatttgtcttcctaccctactcacataattcactcattgactcactcattcaccagatatttattgacctgctattataagcttttacaggtcctcaaaacaaccataacacccacacaagacacaaaaccacaacacacaaaccacaaccaactacacaatatcaaacataaacaccatcacagaaataaagaaagccccccaattaaacacccg

SEQ ID NO: 442046 - DNA, 647 bp, Homo sapiens
ctgggataagggggaagaggaagattatatcttgtgttttgggcatgtcacactagaaatagttcctttaaggtgatgatttttccctccaacagattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacaggtcagtggctaagattggttttccatttggggaatattaaacagagcttttacttgacacttctgtgacagtgatgcaattcgggatcattgtaggttccattgtgaattgtaggttccatgaatgtgaaaatcttcaggacaaattgtcttgcttttattgtctaaacttaggctaaaccctacttctgccacctgttaaattcgttaaaaagtattaattgaccagcctggccaacatggcaaaaccccatctctactacaaatacaaaaaaattaaccaggcgtggtggcgggcacctgtaatcccagctactccagaggcggaggctgaggctgaggctgagctgcaccccagcctgggcaacaagagcaaactccgtctc

SEQ ID NO: 442047 - DNA, 4243 bp, Homo sapiens
tagggctccacagtcgttccgccacctcccagtcgggttgcggcggaggccgttcctggctttgtagctcgctcaagatggcggcgcagccaccccgcgggatacgcctcagcgcgctttgcccgaagtttttacatacaaattctactagtcacacctggccattcagtgcagttgctgaattaatagataatgcttatgatcctgatgtgaacgctaaacaaatatggattgacaaaacagtgataaatgaccatatatgcttgacattcaccgacaatgggaatggtatgacttctgataaattacataaaatgctaagctttggcttcagtgacaaagtcaccatgaatggtcatgtcccagttggattatatgggaatggcttcaagtcgggttctatgcgtctgggtaaagacgcaatcgtttttaccaaaaatggagaaagcatgagcgtgggccttttgtctcagacctacttggaagtcataaaagcggagcatgttgttgttccaatagtggcattcaacaagcaccgacagatgattaatttagcagaatcaaaagccagccttgctgcaattctggaacattctctgttttccacggaacagaagttactggcagaacttgatgctattataggcaagaaggggacgaggatcatcatttggaatcttagaagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggcttattgcagtatattatatctaaagccaagaatgcagatcatcctacgtggacagaaagtgaagacacagctggtttcgaagagtcttgcctacatcgaacgtgatgtttatcgaccaaaatttttatctaaaacagtgagaattacctttggattcaactgcagaaataaagatcattatgggataatgatgtatcacagaaatagactcatcaaagcttatgaaaaagttggatgtcagttaagggcaaacaacatgggtgttggagtggttggaattatagagtgtaatttccttaagccaactcataataaacaagatttcgactatactaatgagtacagacttacaataacagcactaggagaaaagctgaatgattactggaatgaaatgaaagtgaagaaaaatacagaatatcctctaaatttgccagttgaagatatacagaagcgtcctgatcagacatgggttcagtgtgatgcctgtctaaagtggcggaaattacctgatgggatggatcaacttcctgaaaaatggtattgctccaataaccctgacccacagttcagaaattgtgaggttccagaagaacctgaagatgaggatttggtacatcccacttatgaaaaaacctacaaaaagaccaacaaggaaaaattcaggatcagacaaccggaaatgatccctcggattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacagcttgaaacggagactttctactcgttcctcaattttgaatgcaaagaatcggagattgagtagtcagtttgaaaattcagtttataaaggtgatgatgatgatgaagatgtcatcatcttagaagaaaacagtacccccaaacctgcagtagatcatgatattgacatgaaatcagaacagagtcacgttgagcaaggtggtgttcaggttgagtttgtgggtgacagtgaaccttgtggccagactggttcaacaagcacctcatcatcccgatgcgaccagggaaatactgcagctacccagactgaagtaccaagtttagttgttaaaaaagaagaaactgttgaagacgagatagacgtaagaaatgatgcagtgattctgccctcctgtgtagaagctgaagcaaagatacatgaaacccaggaaaccaccgataaatctgcagatgatgcaggctgccaattacaagaactgagaaaccagctactccttgtcactgaggaaaaagagaattataaaagacagtgtcatatgtttactgatcaaatcaaagtgttacaacagaggatactagaaatgaatgacaagtatgttaagaaagaaacttgccatcagtccactgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaattttaaagagatggctttctattaagtataaactatgtatatataagaaccatattttccacaactaaaatgtgcattattttttccaaagttttatcattgctatttatttttacctttgtttttgaacattcaatccgttcattttgtatgtatgcttaatacgtgtcggtcatatacagtattgaatttttactgtatagtaattctggaaagagcaaataaatgaagattgtttttatttgcctgataaagtaattgaaagtgtatttttggtatgaagctggttttctgtcacaattgtaatttcccaaattttaaaatatcttataataaaataaaaatatatgatggctaaatgttcaaat

SEQ ID NO: 442048 - DNA, 306 bp, Homo sapiens
  misc_feature (259)..(259): n is a, c, g, or t
  misc_feature (271)..(272): n is a, c, g, or t
  misc_feature (279)..(279): n is a, c, g, or t
  misc_feature (293)..(293): n is a, c, g, or t
gggattacaggtgtgagccactgggcccagtctgtaatatcctttacattgtatcttttagcttccctgggccacattggaagaattgtcttgggccacattggaagaagaattgtcttgggccacacacacataaaatatactaacgatagctgatgagctttgcccgaagtttttacatacaaattctactagtcacacctggccattcagtgcagttgctgaattaatagataatgcttatgatcctgaatggtgnacgctttgacannggccctncgagatcctcgtangagtcagcctcag

SEQ ID NO: 442049 - DNA, 4354 bp, Homo sapiens
caagggttttgaaccaagtcttggtgagtaagctgtttagttggttcccagtgttatcttccaagaatcgtatattctagattgtatcttccagatgtatcctggagcaagcagctaagtcacttttgtttggtctcaatgttgtttaacacagggataaaaatactggtttttattttcaaaagtaagacctgaattaatttacatggaccttttgtttgtttcagctttgcccgaagtttttacatacaaattctactagtcacacctggccattcagtgcagttgctgaattaatagataatgcttatgatcctgatgtgaacgctaaacaaatatggattgacaaaacagtgataaatgaccatatatgcttgacattcaccgacaatgggaatggtatgacttctgataaattacataaaatgctaagctttggcttcagtgacaaagtcaccatgaatggtcatgtcccagttggattatatgggaatggcttcaagtcgggttctatgcgtctgggtaaagacgcaatcgtttttaccaaaaatggagaaagcatgagcgtgggccttttgtctcagacctacttggaagtcataaaagcggagcatgttgttgttccaatagtggcattcaacaagcaccgacagatgattaatttagcagaatcaaaagccagccttgctgcaattctggaacattctctgttttccacggaacagaagttactggcagaacttgatgctattataggcaagaaggggacgaggatcatcatttggaatcttagaagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggcttattgcagtatattatatctaaagccaagaatgcagatcatcctacgtggacagaaagtgaagacacagctggtttcgaagagtcttgcctacatcgaacgtgatgtttatcgaccaaaatttttatctaaaacagtgagaattacctttggattcaactgcagaaataaagatcattatgggataatgatgtatcacagaaatagactcatcaaagcttatgaaaaagttggatgtcagttaagggcaaacaacatgggtgttggagtggttggaattatagagtgtaatttccttaagccaactcataataaacaagatttcgactatactaatgagtacagacttacaataacagcactaggagaaaagctgaatgattactggaatgaaatgaaagtgaagaaaaatacagaatatcctctaaatttgccagttgaagatatacagaagcgtcctgatcagacatgggttcagtgtgatgcctgtctaaagtggcggaaattacctgatgggatggatcaacttcctgaaaaatggtattgctccaataaccctgacccacagttcagaaattgtgaggttccagaagaacctgaagatgaggatttggtacatcccacttatgaaaaaacctacaaaaagaccaacaaggaaaaattcaggatcagacaaccggaaatgatccctcggattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacagcttgaaacggagactttctactcgttcctcaattttgaatgcaaagaatcggagattgagtagtcagtttgaaaattcagtttataaaggtgatgatgatgatgaagatgtcatcatcttagaagaaaacagtacccccaaacctgcagtagatcatgatattgacatgaaatcagaacagagtcacgttgagcaaggtggtgttcaggttgagtttgtgggtgacagtgaaccttgtggccagactggttcaacaagcacctcatcatcccgatgcgaccagggaaatactgcagctacccagactgaagtaccaagtttagttgttaaaaaagaagaaactgttgaagacgagatagacgtaagaaatgatgcagtgattctgccctcctgtgtagaagctgaagcaaagatacatgaaacccaggaaaccaccgataaatctgcagatgatgcaggctgccaattacaagaactgagaaaccagctactccttgtcactgaggaaaaagagaattataaaagacagtgtcatatgtttactgatcaaatcaaagtgttacaacagaggatactagaaatgaatgacaagtatgttaagaaagaaacttgccatcagtccactgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaattttaaagagatggctttctattaagtataaactatgtatatataagaaccatattttccacaactaaaatgtgcattattttttccaaagttttatcattgctatttatttttacctttgtttttgaacattcaatccgttcattttgtatgtatgcttaatacgtgtcggtcatatacagtattgaatttttactgtatagtaattctggaaagagcaaataaatgaagattgtttttatttgcctgataaagtaattgaaagtgtatttttggtatgaagctggttttctgtcacaattgtaatttcccaaattttaaaatatcttataataaaataaaaatatatgatggctaaatgttcaaat

SEQ ID NO: 442050 - DNA, 2566 bp, Homo sapiens
cagcactttgggaggccgaggtgggtggatcatttgaggtcaggagttcgagaccagcctggccaacatggtgaaaccccgtctctactaaaaagacaagctaggaaacaaaaagctaagggcaaaatgtcatcatcttagaagaaaacagtacccccaaacctgcagtagatcatgatattgacatgaaatcagaacagagtcacgttgagcaaggtggtgttcaggttgagtttgtgggtgacagtgaaccttgtggccagactggttcaacaagcacctcatcatcccgatgcgaccagggaaatactgcagctacccagactgaagtaccaagtttagttgttaaaaaagaagaaactgttgaagacgagatagacgtaagaaatgatgcagtgattctgccctcctgtgtagaagctgaagcaaagatacatgaaacccaggaaaccaccgataaatctgcagatgatgcaggctgccaattacaagaactgagaaaccagctactccttgtcactgaggaaaaagagaattataaaagacagtgtcatatgtttactgatcaaatcaaagtgttacaacagaggatactagaaatgaatgacaagtatgttaagaaagaaacttgccatcagtccactgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaattttaaagagatggctttctattaagtataaactatgtatatataagaaccatattttccacaactaaaatgtgcattattttttccaaagttttatcattgctatttatttttacctttgtttttgaacattcaatccgttcattttgtatgtatgcttaatacgtgtcggtcatatacagtattgaatttttactgtatagtaattctggaaagagcaaataaatgaagattgtttttatttgcctgataaagtaattgaaagtgtatttttggtatgaagctggttttctgtcacaattgtaatttcccaaattttaaaatatcttataataaaataaaaatatatgatggctaaatgttcaaat

SEQ ID NO: 442051 - DNA, 1137 bp, Homo sapiens
tagggctccacagtcgttccgccacctcccagtcgggttgcggcggaggccgttcctggctttgtagctcgctcaagatggcggcgcagccaccccgcgggatacgcctcagcgcgctttgcccgaagtttttacatacaaattctactagtcacacctggccattcagtgcagttgctgaattaatagataatgcttatgatcctgatgtgaacgctaaacaaatatggattgacaaaacagtgataaatgaccatatatgcttgacattcaccgacaatgggaatggtatgacttctgataaattacataaaatgctaagctttggcttcagtgacaaagtcaccatgaatggtcatgtcccagttggattatatgggaatggcttcaagtcgggttctatgcgtctgggtaaagacgcaatcgtttttaccaaaaatggagaaagcatgagcgtgggccttttgtctcagacctacttggaagtcataaaagcggagcatgttgttgttccaatagtggcattcaacaagcaccgacagatgattaatttagcagaatcaaaagccagccttgctgcaattctggaacattctctgttttccacggaacagaagttactggcagaacttgatgctattataggcaagaaggggacgaggatcatcatttggaatcttagaagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggcttattgcagtatattatatctaaagccaagaatgcagatcatcctacgtggacagaaagtgaagacacagctggtttcgaagagtcttgcctacatcgaacgtgatgtttatcgaccaaaatttttaacagatgattaatttagcagaatcaaaagccagccttgctgcaattctggaacattctctgttttccacggaacagaagttactggcagaacttgatgctattataggcaagaaggggacgaggatcatcatttggaatcttagaagctacaaaaatgcaacagagttcgatttt

SEQ ID NO: 442052 - DNA, 371 bp, Homo sapiens
aaaaaaaaaaaccttagaaaattatttataaatagtttttctgttatttaagtttatagagttagttttcatattgtaattatgaaaactatgttgtcaatctgagtctttaacttatgatatacgacagatgattaatttagcagaatcaaaagccagccttgctgcaattctggaacattctctgttttccacggaacagaagttactggcagaacttgatgctattataggcaagaaggggacgaggatcatcatttggaatcttagaaggtaaacgtggacatagatgttgaccgtttgggaagtaaagtgcacgtgcagggtggtggtgttatattcatctctcgttacacacagtagaaatacat

SEQ ID NO: 442053 - DNA, 3570 bp, Homo sapiens
gtatatgcttcagtcttgataaattttaactttttaaatagctttgtgtatattttatggtagtaaattataaaatagactagtatttgcatgttttatgcattcatgacatatctaacttattcttaattttttggatatttctgggcaatgcagttcttggaagtttttttcaaattgttataactctctaaaaaattttctaatttattgaaagaaaattgtgtataagtgcagttcaaacctgtgttgttcaagggtcacctataccttgaatgttctttattaactatatgttttggagttttttctcttcacagtgtctatgtactcattactagattatttatgatttatgtttgaaaagaattttttcttgattttatgatttactttttaagacttacaataacagcactaggagaaaagctgaatgattactggaatgaaatgaaagtgaagaaaaatacagaatatcctctaaatttgccagttgaagatatacagaagcgtcctgatcagacatgggttcagtgtgatgcctgtctaaagtggcggaaattacctgatgggatggatcaacttcctgaaaaatggtattgctccaataaccctgacccacagttcaggtaccatagagttggtagtaccctttttggaaagacggaaagtactgttcacagtgtatgaataggcgctggtgacatgttattcctatgtgatttttctgaatagaaattgtgaggttccagaagaacctgaagatgaggatttggtacatcccacttatgaaaaaacctacaaaaagaccaacaaggaaaaattcaggatcagacaaccggaaatgatccctcggattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacagcttgaaacggagactttctactcgttcctcaattttgaatgcaaagaatcggagattgagtagtcagtttgaaaattcagtttataaaggtgatgatgatgatgaagatgtcatcatcttagaagaaaacagtacccccaaacctgcagtagatcatgatattgacatgaaatcagaacagagtcacgttgagcaaggtggtgttcaggttgagtttgtgggtgacagtgaaccttgtggccagactggttcaacaagcacctcatcatcccgatgcgaccagggaaatactgcagctacccagactgaagtaccaagtttagttgttaaaaaagaagaaactgttgaagacgagatagacgtaagaaatgatgcagtgattctgccctcctgtgtagaagctgaagcaaagatacatgaaacccaggaaaccaccgataaatctgcagatgatgcaggctgccaattacaagaactgagaaaccagctactccttgtcactgaggaaaaagagaattataaaagacagtgtcatatgtttactgatcaaatcaaagtgttacaacagaggatactagaaatgaatgacaagtatgttaagaaagaaacttgccatcagtccactgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggttgaattgctggaaatggaaaagtcacaaatccgttcacagtgtgaagaactcaaaactgaagtagaacagttaaaatctacaaatcaacagacggcaacagatgtttcaacatcaagtaacattgaggagtctgtaaatcatatggatggagaaagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaattttaaagagatggctttctattaagtataaactatgtatatataagaaccatattttccacaactaaaatgtgcattattttttccaaagttttatcattgctatttatttttacctttgtttttgaacattcaatccgttcattttgtatgtatgcttaatacgtgtcggtcatatacagtattgaatttttactgtatagtaattctggaaagagcaaataaatgaagattgtttttatttgcctgataaagtaattgaaagtgtatttttggtatgaagctggttttctgtcacaattgtaatttcccaaattttaaaatatcttataataaaataaaaatatatgatggctaaatgttcaaat

SEQ ID NO: 442054 - DNA, 2187 bp, Homo sapiens
tagggctccacagtcgttccgccacctcccagtcgggttgcggcggaggccgttcctggctttgtagctcgctcaagatggcggcgcagccaccccgcgggatacgcctcagcgcgctttgcccgaagtttttacatacaaattctactagtcacacctggccattcagtgcagttgctgaattaatagataatgcttatgatcctgatgtgaacgctaaacaaatatggattgacaaaacagtgataaatgaccatatatgcttgacattcaccgacaatgggaatggtatgacttctgataaattacataaaatgctaagctttggcttcagtgacaaagtcaccatgaatggtcatgtcccagttggattatatgggaatggcttcaagtcgggttctatgcgtctgggtaaagacgcaatcgtttttaccaaaaatggagaaagcatgagcgtgggccttttgtctcagacctacttggaagtcataaaagcggagcatgttgttgttccaatagtggcattcaacaagcaccgacagatgattaatttagcagaatcaaaagccagccttgctgcaattctggaacattctctgttttccacggaacagaagttactggcagaacttgatgctattataggcaagaaggggacgaggatcatcatttggaatcttagaagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggcttattgcagtatattatatctaaagccaagaatgcagatcatcctacgtggacagaaagtgaagacacagctggtttcgaagagtcttgcctacatcgaacgtgatgtttatcgaccaaaatttttatctaaaacagtgagaattacctttggattcaactgcagaaataaagatcattatgggataatgatgtatcacagaaatagactcatcaaagcttatgaaaaagttggatgtcagttaagggcaaacaacatgggtgttggagtggttggaattatagagtgtaatttccttaagccaactcataataaacaagatttcgactatactaatgagtacagacttacaataacagcactaggagaaaagctgaatgattactggaatgaaatgaaagtgaagaaaaatacagaatatcctctaaatttgccagttgaagatatacagaagcgtcctgatcagacatgggttcagtgtgatgcctgtctaaagtggcggaaattacctgatgggatggatcaacttcctgaaaaatggtattgctccaataaccctgacccacagttcaggtaccatagagttggtagtaccctttttggaaagacggaaagtactgttcacagtgtatgaataggcgctggtgacatgttattcctatgtgatttttctgaatagaaattgtgaggttccagaagaacctgaagatgaggatttggtacatcccacttatgaaaaaacctacaaaaagaccaacaaggaaaaattcaggatcagacaaccggaaatgatccctcggattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacaggtcagtggctaagattggttttccatttggggaatattaaacagagcttttacttgacacttctgtgacagtgatgcaattcgggatcattgtaggttccattgtgaattgtaggttccatgaatgtgaaaatcttcaggacaaattgtcttgcttttattgtctaaacttaggctaaaccctacttctgccacctgttaaattcgttaaaaagtattaattgaccagcctggccaacatggcaaaaccccatctctactacaaatacaaaaaaattaaccaggcgtggtggcgggcacctgtaatcccagctactccagaggcggaggctgaggctgaggctgagctgcaccccagcctgggcaacaagagcaaactccgtctc

SEQ ID NO: 442055 - DNA, 831 bp, Homo sapiens
tagggctccacagtcgttccgccacctcccagtcgggttgcggcggaggccgttcctggctttgtagctcgctcaagatggcggcgcagccaccccgcgggatacgcctcagcgcgctttgcccgaagtttttacatacaaattctactagtcacacctggccattcagtgcagttgctgaattaatagataatgcttatgatcctgatgtgaacgctaaacaaatatggattgacaaaacagtgataaatgaccatatatgcttgacattcaccgacaatgggaatggtatgacttctgataaattacataaaatgctaagctttggcttcagtgacaaagtcaccatgaatggtcatgtcccagttggattatatgggaatggcttcaagtcgggttctatgcgtctgggtaaagacgcaatcgtttttaccaaaaatggagaaagcatgagcgtgggccttttgtctcagacctacttggaagtcataaaagcggagcatgttgttgttccaatagtggcattcaacaagcaccgacagatgattaatttagcagaatcaaaagccagccttgctgcaattctggaacattctctgttttccacggaacagaagttactggcagaacttgatgctattataggcaagaaggggacgaggatcatcatttggaatcttagaaggtaaacgtggacatagatgttgaccgtttgggaagtaaagtgcacgtgcagggtggtggtgttatattcatctctcgttacacacagtagaaatacatggaaaggtactcattttttggtgtagttactgatttgtctttgcccag

SEQ ID NO: 442056 - DNA, 3509 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaactgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactcca

SEQ ID NO: 442057 - DNA, 3691 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcagcagggcacagggtttttccctttaacaacaacacacattcccaaaatttttttttggggccccggggaaacacgggcggggccaacacaccccacacaagggggaaaaaaaacccttttgggtgtttggggaaaaacactttccccctttggcctttggggtttggggctaacgccaggacacggacaggtcaccagggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactcca

SEQ ID NO: 442058 - DNA, 3505 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactcca

SEQ ID NO: 442059 - DNA, 3642 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccatatatgtctccttgtctgcctgaattctataattgtgtaaagaaaaataaactttagtatgacgctgttttaaaaggag

SEQ ID NO: 442060 - DNA, 3836 bp, Homo sapiens
  misc_feature (3586)..(3586): n is a, c, g, or t
  misc_feature (3721)..(3721): n is a, c, g, or t
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccaaaaaaaaaaaaaaaaaaaaaaanaaaaaatgttggggcggctttggccaaacgattctagaattaaagcaacttaatattgggcccgaaattgaggcgatttggccaatatcccataatggggggggttaaaattaactgcggggggttttaaaaacnggaatgggaaaaaaaggggggcccacctaaataagtgggggaaaaaccctttctcacttggggttataaaaaaacccgccccccccccttccaaaaataggaaccgatggggagg

SEQ ID NO: 442061 - DNA, 2270 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatagcttgccgtggtaccgaggctcgaaattacgtacatcaatggtccatagcctgttttcca

SEQ ID NO: 442062 - DNA, 1574 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaacagcgagaatctgtctcaaaaaataataataatagtaaatagagtaagtgaggcacgagattgggcccttcaatctcaaagtccccaaagcgaataagggga

SEQ ID NO: 442063 - DNA, 3563 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactcca

SEQ ID NO: 442064 - DNA, 3503 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactcca

SEQ ID NO: 442065 - DNA, 3509 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaatattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactcca

SEQ ID NO: 442066 - DNA, 3991 bp, Homo sapiens
  misc_feature (3586)..(3586): n is a, c, g, or t
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccaaaaaaaaaaaaaaaaaaaaaaanaaaaaaaaaaagaaaaaaaacagaacgcaaaacacaaaaaaagggggggggggggaaaagaacccgggggggacaccagatagcgtcgcgccgattttgtgaaacaacggcgcccactaggggaccatataaagccagagcgggggcgcgtaaaaacagcggcggcgggcgacaaaccgcctctgcgtcatgtgggggaagaacccttctgcggggggcacaatggcaccccccaccgatgacaggcggggaaaaaaagcttggtgttggtggtgcacccgccatgtccgtgcaaggctgctaataaatctctacattcatacgtagatacatagagacgactcagcagtgcacgtgaatgtcatcatgatagcagcagaacatacgtctgcgcacgagaatgaa

SEQ ID NO: 442067 - DNA, 3587 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaacccttgttttatttaagagacagaggagaaagtggagcggggagggaatcctagcttattttcccttttctatgaggacttgacacaggttctgctgagttgtcactgctgctccagactcacctagagatgctgcctccactttccatcctgtctgggtctgaaaacagtgggtctgcagatagtgcccacaaaccccatgtgactggtttgaaggacccagagcataaaggtctctcaggaaaccatgtccaaaaccctagcagcggtacagcatgctgtctccaacccttatccccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcacccggcagagttttataatgaaaaattaactaatattctagtatgaagtgaggaggatactgaacaggatgtggctaaagccaacctgggacagccatggggtggcttggtttcttcactccagtgttgtccctaccatttcgcagcattgatttaggaggctctgggacaaaagagaagccaaagagcagttttcccagttcactcactctggcaaaatcaggaaaaaaaagtctgcttttgacatcaaattccactaatttggggcagcgttgggtgaggaaagtattgtgaagacaggcttcttggagtaggggcagccacaattcagtagacactctaggctcggaggctgccactgtagttgccaagctcaggttgggtggttctgtgctgtatggatggaataggacctgggctggtcatcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccatatatgtctccttgtctgcctgaattctataattgtgtaaagaaaaataaactttagtatgacgctgttttaaaaggag

SEQ ID NO: 442068 - DNA, 1852 bp, Homo sapiens
ggcccagttggcggcgcgcactccaggtggcggccggctgcgggccgcggccagagggctagaatccgcgccttccgagggagccgcgccctgcgggccccaccgtacccgaggggatggagggctgcccccgaggcccccgcgcggctcgcggtcccacgcctgccggcccgcgctagctactcgactcgtgcgctaaatttatccgtcacccaggccttgtctcccgagtcattggcgtcgtggttcaaaagaaatggaagaaaaggagcgatgtgaccgattgtgttcggtcctcctgctttgaggcctggcatttgcagagggaaacagcaagaaaatcgtggggattttggaggggggtgggagggaagggtggggaaacggaaacaaggtcttacattttatgtgtttttttaaattctgcactttgacagtggtagcaaaataaaagtaatccaaaagttatttttctattgagaagagagaagaggtgggttttatttttttccttttgattccaatcttttctcccagtgacaaagcataaatcatggacaccagagaataaggtggacctcaggaatccggaaaagactgagaagcttacattcttcctctagagggaagagtggggtgtttatagccatctctggaacctaaaacaaaaaacatgagttgtgtgccatggaaaggagacaaggccaaatctgaatcattggagctgccccaggcagcacccccacaaatctaccatgagaaacagcgcagggagctttgtgccctccacgccctcaataacgtcttccaggacagcaatgccttcacccgggatacgctgcaagagattttccagaggttgtctccaaacaccatggtgacacctcacaagaagagcatgctgggaaatggcaactacgatgtgaatgtcattatggcagcacttcagaccaaaggctatgaagctgtttggtgggacaagcgcagggatgtcggtgtcattgccctcactaacgtcatgggcttcatcatgaatctgccctccagcctatgctggggtccactgaaactgcccctcaaaaggcagcactggatctgtgttcgagaggtgggaggggcctactacaacctcgactccaaactcaagatgcccgagtggattggaggcgagagcgagctcaggaagtttctaaaacatcatttgcgaggaaagaactgtgaactcctgctggtggtaccagaagaggtagaggctcatcagagttggaggaccgatgtgtaacagttctgcccaacctccctctcgcctcagccccttcagtcctctgtgacgtgctgtggcctctacagtgggtctgcccttgccacttccccaaacatctcatcaagtttttccccttcagatctgacagtgcaataggacagacgtgtggactgttataagaactactcagtgttttgttcctgggcaaggaaggtaggagttctgtgcacttaaggccagtggtcacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactcca

SEQ ID NO: 442069 - DNA, 2893 bp, Homo sapiens
  misc_feature (867)..(867): n is a, c, g, or t
  misc_feature (1372)..(1372): n is a, c, g, or t
  misc_feature (2893)..(2893): n is a, c, g, or t
gtcatggagtgtctgcacgggacgtcctggagagtcggacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggaggtcaacattggcatcctcatcgctgtgaccagagtcatctcacagatcagcgccgacaactacaagatccatggagaccccagtgccttcaagttgacggccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctccgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggcccgagacagctgtcctcccctgtgactctggctgtcggagcacactgctcagcccagcangctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgngggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagactcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctgaaaagaaaan

SEQ ID NO: 442070 - DNA, 278 bp, Homo sapiens
atcaaggtctttgggacggcggacagcaagcaccgttactactatgggatgggatggggttttcctcttctgatctgcatcatttcactgtcatttgccatggacagttacgggacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacccaaagcacagcgccgtcccaaagcacag

SEQ ID NO: 442071 - DNA, 2703 bp, Homo sapiens
  misc_feature (677)..(677): n is a, c, g, or t
  misc_feature (1182)..(1182): n is a, c, g, or t
  misc_feature (2703)..(2703): n is a, c, g, or t
atgatttctttgtgcagttagcaccggtggacaccaggagctgctggtcaacattggcatcctcatcgctgtgaccagagtcatctcacagatcagcgccgacaactacaagatccatggagaccccagtgccttcaagttgacggccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctccgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggcccgagacagctgtcctcccctgtgactctggctgtcggagcacactgctcagcccagcangctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgngggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagactcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctgaaaagaaaan

SEQ ID NO: 442072 - DNA, 567 bp, Homo sapiens
actaatcagtcattaggttctctggcaagtgaaaaatggaataaagataaagaatgtagtggttaatcaagagtaacctgtttataacatagactaggctcaaaacttaaacttgaaacttaacacaataaattaaaccatctttgtaaacagtagaatttaaagagattcccttaaacattaaacattaggaccttctgtggtgtcaccttattcaaactaccactgtgttacctctttttgactcttaaggctgccagacaccctacttgaaggatcctgttggaacctgtggaaataatacttacaagaacgttgcagctaagctggtccgggtgcagtggtgttacaactaatggatcacaaccagtcacggatttctttgttccatctccattcccacttcttcacttgactagccttaaaaaggctcatgcctgtaatcccagcactaagggaggctcagacagaaggatcatttgagcccaggagtttgagatcagcccaggcaacatagcgagacttcatctctactaaaaataaaataaaaaaattagccaggagtgg

SEQ ID NO: 442073 - DNA, 757 bp, Homo sapiens
ctcctgctgtgtggcccagttcctaacaggccacgaactggtactgattgttccccagagtttggggaccccttgtcttgacagtatcatgcacaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagttaaagtctcaagaaaatggggtttccagagcatccaagtacttttataaaggggaatggaaaccaatgattt

SEQ ID NO: 442074 - DNA, 756 bp, Homo sapiens
gtaaagtaccttgtttcatgctcccagctgatcaatatttttattttccaggcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagcatttacaagttactccaagaaaacatgggggttattccccaagaagcccattccaaggctaccttttattattaaaaaaggcaggcaaattgagaaatcccccaacattgattatcaggaaagggccccgttgccctccatgcgaaaaagccaaccagggtggcgcctccaacgaacacattacaggaaagcacaataaaggaacacttgcacgaaacaacgaaattagaaaacctggggaagaacgccaccagggacagggctggacaggaccattcggtgaacgtgggattgaacgattttctccccaagggggcccctaggagacctaactccttcttcctgggcaagttttttacaaaaccccaagaaaggccttctaaaggccccttttcacccggtttcaatcacatataacccaacacgttccaacgacgaacgacaaaggtcttcccaa

SEQ ID NO: 442075 - DNA, 542 bp, Homo sapiens
caagttgcgagaccccgtctctgaaaaaaaaaaaaaaatcaaatttgccaggtgtggtgttgtgagccaatcctcccacctcagccccccgagtagctgggactacaagtatgtaccaccacatccagctaatttttgcattttttgtagagatgggttttgcccatgttgcccaggctggtctcaaactcccgggctcaagcgatccacttgcctcagcttcctaaagtgttgaggttacaggtgtgagccacgatgctgggcctagctttctatgtggccagtttctctggtatttttctctggaaattgcagcgactttgacctgtgtacattctgtgatctgtccttgacactcaattacgtagatggggtctggtttgactacctcctcccttacaaggtggccaggaaaccttctcaatgtaagattcaacttacctatttcctttctctccaggatcactattctgccatgtctgtgtgtctaaaagtgtttcaggcagaggcagggggatctcttgaggctaggagtttgatat

SEQ ID NO: 442076 - DNA, 460 bp, Homo sapiens
tctagggcaggagatactaaagggggaaaaatactaaatcatctgtttgatattaatatgaattcttattttattccccagtctgccttaactagctgctttatgcatcatccaggttttctggattcagtggaaaagacaaggtagtgtgtgcttattccatcttacttggaattggaactcctggtatatttggaaatcaacaaaaatgttaaaacgtaagaaacaattgtaactctaatgtatgggtttccccatattctttgttttatgcttcatgttgtttaagaatacatgcattaggctgggcacggtggctcacgcctgtaaatcccagcactttgggaggctgaggcgggtggatcacctgaagtcaggagttcgagaccagcctgaccaacatggaaaaaccctgtctctactaaaaaaaaataccaaattagctgggcgtggtggtgct

SEQ ID NO: 442077 - DNA, 426 bp, Homo sapiens
agttagccccgataatttctacccaaacacctccaaattatgctacttcaaaaacagttgaagggaagtttaggaatataatatagtttcattttaagaccactaggataatagacattgtaatgtaatggaaaaacattttgtcccataaaaaccactttcatttaatgctttgtttttctgtctaaccaggtaatacctagcaaatacagaaagagagataaagcaagcaagctgttttgaaagtgtctaatattggctgatgtagagctatagaatccatcagtagaagaattattttgtacactatgtgtgaaagatcaaagaatatggggcagtcaccagttgtttacaacctggtttgcaagtggcataaaaaaatattagtttgtctgctgaataaaattaaacttatttttctctctg

SEQ ID NO: 442078 - DNA, 2832 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcagtgagtatgtgtgtgacggacccccgccgcccgcggctcgggacccctgcctaccctccttcttgcccgccgggctgtggaactagcgcgtgccccctcgccggcctcgacgtctcccgtccgcccctcactcgtggcagggcgcagctcctgcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442079 - DNA, 2670 bp, Homo sapiens
actgagaaggcgtccaccgagcgccagggagaaggaggcggagcccggcctcaacctcgcccgtgtcctcatgggggttgtagttttcctcgcgggggtagagggcacgaactccccggcttttgcccgcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442080 - DNA, 2950 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcagtgagtatgtgtgtgacggacccccgccgcccgcggctcgggacccctgcctaccctccttcttgcccgccgggctgtggaactagcgcgtgccccctcgccggcctcgacgtctcccgtccgcccctcactcgtggcagggcgcagctcctggtccgtcacctgcgcgccgccccacgcggccgggctgcgggtctagggggtccgcgtctccctggctttccaagggctaatgccgtgattctagagcggctgggcgtctagggcctcgcttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442081 - DNA, 2585 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442082 - DNA, 2738 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactggggccatcgtgacaaatctgataggataaacagatagatagatgatcccttcctacgaaccatatgtgggcgatagttgaaaccactgcttgttaacttgctgtgcggatgattgtgtcttccactgggtgccctcaatgagatcgctagacatttgccgaagacggatataaacctgcctaacctgcggcaactcgagcacaagataggccgcaaggcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442083 - DNA, 2050 bp, Homo sapiens
aagcagtggtatcaacgcagagggcccattacggccgggggaaaaccatgagccattgagttttgtgaattcaagttagacagtaacagaggccaagactctaagcgaacaatatctgaaaaggaagtacacaaaaacaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442084 - DNA, 2048 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcagagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442085 - DNA, 1697 bp, Homo sapiens
ccgtattattctgaggacactgtggtaatcaagaactatccataactaatgtataaataactgcttgcttatttctacaataatccaactcaaattatatatacacagcaaaaagcttatgatagaaggcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442086 - DNA, 1965 bp, Homo sapiens
tcagatttagtcatgctgttattttagcccagtggtccagagagatgactgaaaagagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442087 - DNA, 1620 bp, Homo sapiens
gtaaagtaccttgtttcatgctcccagctgatcaatatttttattttccaggcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442088 - DNA, 1660 bp, Homo sapiens
gttacaaacaacacactttttgctcctgagaagatggtaaactgatcaactatacataagcagcttggttagaaaaagtgtccttaacaaggcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442089 - DNA, 1698 bp, Homo sapiens
gttacaaacaacacactttttgctcctgagaagatggtaaactgatcaactatacataagcagcttggttagaaaaagtgtccttaacaaggtcataatttaggcataagaagatttatatatgtgttcgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442090 - DNA, 1713 bp, Homo sapiens
agttagcaccaagtgattccgtaaaagatgccaacagctatcacaaatatgtaataacagtgaagtcttcttaaagcagttactattaaattgttttccatcttactaccaaagttcaaaatgctgttttaaaaggtgtacttggcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442091 - DNA, 1772 bp, Homo sapiens
caatgccaaattgaatgaggagggaagaaggagagggaagcacacattgacattaagagtaaaagaattgttcttaccatgttatatactttaatatatggaatcgcctgaatacaggtctccatacaaaactctaagaaacttctaaggaatcccttacctataaagctcttttggaaagaatgaggttttaattttcttctaacatcaacaaaccctcacaaatattcatgttgcagaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442092 - DNA, 1570 bp, Homo sapiens
tttctatatttttgcatcattaagcccatactcaggcaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442093 - DNA, 1524 bp, Homo sapiens
gtaaagtaccttgtttcatgctcccagctgatcaatatttttattttccaggcttgcacagaaatctggaggcagtatcacctaacggaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442094 - DNA, 1475 bp, Homo sapiens
tgaccatgtgacatcataattttacatacaatttataggaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442095 - DNA, 1320 bp, Homo sapiens
  misc_feature (1257)..(1257): n is a, c, g, or t
  misc_feature (1259)..(1259): n is a, c, g, or t
  misc_feature (1261)..(1261): n is a, c, g, or t
  misc_feature (1265)..(1265): n is a, c, g, or t
  misc_feature (1278)..(1279): n is a, c, g, or t
  misc_feature (1282)..(1283): n is a, c, g, or t
  misc_feature (1301)..(1301): n is a, c, g, or t
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacccagtatatgattgngnangacntatttgcatattnntannaattgaatagatatactnagcagactaggtaatcaga

SEQ ID NO: 442096 - DNA, 1150 bp, Homo sapiens
  misc_feature (1087)..(1087): n is a, c, g, or t
  misc_feature (1089)..(1089): n is a, c, g, or t
  misc_feature (1091)..(1091): n is a, c, g, or t
  misc_feature (1095)..(1095): n is a, c, g, or t
  misc_feature (1108)..(1109): n is a, c, g, or t
  misc_feature (1112)..(1113): n is a, c, g, or t
  misc_feature (1131)..(1131): n is a, c, g, or t
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaagaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacccagtatatgattgngnangacntatttgcatattnntannaattgaatagatatactnagcagactaggtaatcaga

SEQ ID NO: 442097 - DNA, 1084 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggctgccagacaccctacttgaaggatcctgttggaacctgtggaaataatacttacaagaacgttgcagctaagctggtccgggtgcagtggtgttacaactaatggatcacaaccagtcacggatttctttgttccatctccattcccacttcttcacttgactagccttaaaaaggctcatgcctgtaatcccagcactaagggaggctcagacagaaggatcatttgagcccaggagtttgagatcagcccaggcaacatagcgagacttcatctctactaaaaataaaataaaaaaattagccaggagtgg

SEQ ID NO: 442098 - DNA, 391 bp, Homo sapiens
aacaaagatatgtgtattatatataaaattaatgtggtaaccttttcatcttattctccttagaatccatcagtagaagaattattttgtacactatgtgtgaaagatcaaagaatatggggcagtcaccagttgtttacaacctggtttgcaagtggcataaaaaaatattagtttgtctgctgaataaaattaaacttatttttctctctgtagcatattaattgtattatagtatgccacagccacttccagtgcaatcctcctagtcttggaacagcagccaattccaggaattaagagaattaggttactttgcctagtggcacaaaaaataccaaggtattaaatcattggcttgtctgtttggggcacaatcagaaataaagtt

SEQ ID NO: 442099 - DNA, 127 bp, Homo sapiens
tactcataaattgtgtaatctattgtcaatctataagtcctttaaaagtgccacggttaagtaataatttatttgttttgtaggagaagatggtataaactggtccatcagtgacaaagacattgag

SEQ ID NO: 442100 - DNA, 432 bp, Homo sapiens
tcatgctcctatgagaatctaatgcagcagctgatttgacaggaggcggagctcaggctctaattctgactagcctgccggctgctcacctcctgctgtgtggcccagttcctaacaggccacgaactggtactgattgttccccagagtttggggaccccttgtcttgacagtatcatgcacaggtaggtacttttaagctgtttgatattattgtttctacttcgggagatgggaagataaatggaataaaatgagcaaagtggcagtgccattaaagatctgtggatatctgatttctcacagaattcacagaattacccttcattaaaagatgcaaatggcagttttatgaagtctttttgccctgttttgtgttgggtgttcagtacagatgcaatttttttttttttaaattttcgatacagggtt

SEQ ID NO: 442101 - DNA, 1116 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcagtgagtatgtgtgtgacggacccccgccgcccgcggctcgggacccctgcctaccctccttcttgcccgccgggctgtggaactagcgcgtgccccctcgccggcctcgacgtctcccgtccgcccctcactcgtggcagggcgcagctcctggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatcttgcaccagaaatctggaggcagtatcacctaaagaccaaactgagacacccaaaagccgaagacccttcagaaccatagcttagcatattgtatcacgggcgcaaaggcctttggcccgaaggtccgacagagactttttaccggtccaaaatctcaataaatggcaacatgacgcccaattgaatacggagacaacaacacataaacagaaacacactccaaaaaagggtctcaaaacacaagacgataataaaccacgtaatacccgcacaatcaaggagagcgccacatcaccaaagagggcccaacaaagaacaacaagagagaacaaccagcgtgaaagcacggcaacacacacgagaagtaacagtccaacactcatgtataaaaaaagcagcagaaacaagaccagcgggacagaacagaatcaaacaggctctgcgtgaactcactggctctgcgctgtcgtctcaaacaaacc

SEQ ID NO: 442102 - DNA, 2679 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442103 - DNA, 1803 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacggccactcaataaccatgttggccaggctggtcttgaactcctgacttcaggtgatctgcccacctcagcctaccaaagtgctgaaatttgcaggcgtgagccaccatgcccttattgagtggccactcaatagggatctccagaa

SEQ ID NO: 442104 - DNA, 1710 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcactagttgttcatcaatacttgactggcggggatccatctagaaagtcgacctgc

SEQ ID NO: 442105 - DNA, 2509 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaagaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442106 - DNA, 2079 bp, Homo sapiens
tgtacccaccaaaaaaaaagagagagagagagaaagcgactttgttctgcaaacgttggcctaagctttgaaaaccatgagccattgagttttgtgaattcaagttagacagtaacagaggccaagactctaagcgaacaatatctgaaaaggaagtacacaaaaacaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442107 - DNA, 2123 bp, Homo sapiens
acctattcccttgatgtctgcagtatcacctttcttgtagcttcacgtgtatgtggccaaaagaacaactcttttctaaaaggcctggagaacattatcagggtctccctctgttgcccaggctggagtgtggtggcgcgatcttggctcagcgcaacctgctggactcaagcaatcctcccacctcagccccccgagtagctgggactacaagagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442108 - DNA, 2263 bp, Homo sapiens
ctcctgctgtgtggcccagttcctaacaggccacgaactggtactgattgttccccagagtttggggaccccttgtcttgacagtatcatgcacagtgccaagatttcactatgttgccccagtctggtctcgaactcctgggctcaagtgatcctcccacctcagcctcccagagtgctggaattaggtgtgagacaccatgcccagcccctgagtctgccttaactagctgctttatgcatcatccaggttttctggattcagtggaaaagacaaggtagtgtgtgcttattccatcttacttggaattggaactcctggtatatttggaaatcaacaaaaatgttaaaacgagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442109 - DNA, 2006 bp, Homo sapiens
aagcagtggtatcaacgcagagggcccattacggccgggggaaaaccatgagccattgagttttgtgaattcaagttagacagtaacagaggccaagactctaagcgaacaatatctgaaaaggaagtacacaaaaacaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgcttgcacagaaatctggaggcagtatcacctaacgaccaaacctggaccacccaaaaagccgaagaccccttcaagaccatcagccttagcatattgctatcactgcgcgcaaaaaggccattatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442110 - DNA, 2244 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442111 - DNA, 1585 bp, Homo sapiens
  misc_feature (1)..(1): n is a, c, g, or t
  misc_feature (24)..(24): n is a, c, g, or t
  misc_feature (102)..(102): n is a, c, g, or t
ngggcgatggtaccggcccccctngggtcgacgtatcgattagctggtatcgaattgcgccgcgtcgacggtgcgagagacgacgagggacccttcagaccntcgccttagctattgctatcatgcgcgcaaaaggccttatggacacgaatgtccagaaagagaagtgtatgacccgtctccagtatctccattcatctgctactatgatgacaaatatgaaattcaggagagagaaaagagactaaaacaaaaaataaaagtactcaagaaaaatggggttatcccagagccatccaagctaccttatataaaagcagcaaatgagaacccccaccatgatataaggaagggccgtgcctcatggaaaagcaacaggtggcctcaagaaaataaagaaacacaaaaagaaatgaagaacaagaatagaaactgggagaagcacaggaaggctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442112 - DNA, 1703 bp, Homo sapiens
ctcctgctgtgtggcccagttcctaacaggccacgaactggtactgattgttccccagagtttggggaccccttgtcttgacagtatcatgcacagattgggattctcacttgagccagagaggcggaggttgcagtgagccaagattgcaccactgtgctccagcctggtgacagagcaagattccatcccccctaaaaaagaaaaaagattgggattctgcttaaggagaagatggtataaactggtccatcagtgacaaagacattgaggcccagatagctaataaccgaacacctggaagatggacccagcggtactattcagccaacaaaaacattatctgtagaaattgtgacaaacgtggtcatttatcaaaaaactgccccttaccacgaaaagttcgtcgctgcttcctgtgctccaggagaggacatctcctgtattcctgtccagcccccctttgcgaatactgtcctgtgcctaagatgttggaccactcatgtcttttcagacattcctgggataaacagtgtgaccgatgtcatatgctaggccactatacagatgctgacagacatcgtgaagtggatgaggattttcccaggggccccaaaacctactcttctcctggcagttttaaaacccagaagccttctaagccctttcaccgttcatcacattaccacacgtcaagagaagacaagtctcccaaggaaggcaagaggggcaagcagaagaaaaaggagaggtgctgggaagatgatgacaatgataacttatttcttattaagcagagaaaaaaaaagtcttaagccgtcaggcagcctctgatgtggcttttcattgttcatttggcctttgtgtctataaccttctggcactgtgtttattatctatgattaaataaagtgagtttttggtttggttttttaatttcagccattcctagagttactgaatatccatggagatctcaattctctgtgtccaacaggatattaggtaagaaagtacaaagataaacctggacttctcctattccaatatgtcatctttactcagaatcctagggataggtagaagaattcatcttttcaagaaagtgttttaaaaatactttgggaaaaaaactgcatcaaaggtaatttatcctcaaattaaatccttgcaggaagagaaattaacactaagaaaaagtcatcaatatttttcaactttttttttttttttttttactttggaaaggacaataactataaacctatatccagattttctttctgctgaagctgttgtcagaatcttcctttggacaaaacatcactagctgactataaaaacaaaagtgtcatcattgaagccctgaagaggcagggaattgagcttcagcaaaatacaggaaaagaactatccagtataaatgtcagaagacagatttcctaaacaagtaaaagagacatcaaaaattttaacataatcacaatgaaatcattttttaccacttttacagcggtgtttcaagcggactgtcactcagatctgcagagatgaatattactcaaaaaatttttttgttctcttgcatttttttcaactaccgcaaagctatacagatttttttgtacttgtggatcttttgtacttctcataacctaatgtcagactaagaaaaataaaatatctgagagtaaaaaaaaaaa

SEQ ID NO: 442113 - DNA, 1168 bp, Homo sapiens
agagctgtgttgtccccggaagtgccttccctcccgggtctgcgcggacgcggcctccttacctcatttgtcctcgcccctccccgtccctctacgcgtttggttcccggttggtgcttcctgttcgcagctgcggcacttcaaggttactgactttttatgatgtttggtggctatgagactatagaagcatacgaagatgatctttatcgagatgagtcatctagtgaactgagtgttgatagtgaggtggaatttcaactctatagccaaattcattatgcccaagatcttgatgatgtcatcagggaggaagagcatgaagaaaagaactctgggaattcggaatcttcgagtagtaaaccaaatcagaagaagctaatcgtcctttcagatagtgaggtcatccagctgtcagatgggtcagaggtcatcactttgtctgatgaagacagtatttatagatgtaaaggaaagaatgttagagttcaagcacaagaaaatgcccatggtctttcttcttctcttcaatctaatgagctggttgataagaaatgcaagagtgatattgagaagcctaaatctgaagagagatcaggtgtaatccgagaggtcatgattatagaggtcagttcaagtgaagaggaagagagcaccatttcagaaggtgataatgtggaaagctggatgctactgggatgtgaagtagatgataaagatgatgatatccttctcaaccttgtgggatgtgaaaactctgttactgaaggtaatacctagcaaatacagaaagagagataaagcaagcaagctgttttgaaagtgtctaatattggctgatgtagagctataggctgccagacaccctacttgaaggatcctgttggaacctgtggaaataatacttacaagaacgttgcagctaagctggtccgggtgcagtggtgttacaactaatggatcacaaccagtcacggatttctttgttccatctccattcccacttcttcacttgactagccttaaaaaggctcatgcctgtaatcccagcactaagggaggctcagacagaaggatcatttgagcccaggagtttgagatcagcccaggcaacatagcgagacttcatctctactaaaaataaaataaaaaaattagccaggagtgg

SEQ ID NO: 442114 - DNA, 2204 bp, Homo sapiens
gagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgatccctgtcagatgaaaatgattcacagctctggcagttcccaagtctggggaggggtataggtttgaaaggctgtttgaaagaggaatgtttaataaaggctttgatttaatcttga

SEQ ID NO: 442115 - DNA, 2468 bp, Homo sapiens
  misc_feature (2304)..(2305): n is a, c, g, or t
  misc_feature (2313)..(2313): n is a, c, g, or t
  misc_feature (2321)..(2321): n is a, c, g, or t
gagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgatccctgtcagatgaaaatgattcacagctctggcagttcccaagtctggggaggggtataggtttgaaaggctgtttgaaagaggaatgtttaataaaggctttgatttaatcttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacattgtnncccacttngcccaacncttttttaaattctacaaattattcgaatcggccccaatttggggccaatttgccccaatcccccctaaggtggccccttttacaatccattgcccgttttttacacacggcttaccggcgctctgggtaacccctttcccctttgt

SEQ ID NO: 442116 - DNA, 1512 bp, Homo sapiens
tatccttggcgacagagcgaggccctgtctctaaaacaaacaaacaatactgaatttgcagtggtcccgtagccctgagtgtctctgctcaaagaacacagctgtaagcccggagtggttcatgagcaggctttccttactttccttaatgtgccactttggggagcttctgccaagatagcagggaggtccatgtgaatgtggcctggagttttccttgtgctctgggtcagcacactggtctccagcggggtgggcccatgggcctcatgggtgctggggacatgctgtaaaataccggttgatcccagtcgtgtccttccacccagcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgatccctgtcagatgaaaatgattcacagctctggcagttcccaagtctggggaggggtataggtttgaaaggctgtttgaaagaggaatgtttaataaaggctttgatttaatcttga

SEQ ID NO: 442117 - DNA, 1949 bp, Homo sapiens
gagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcattcccaagtctggggaggggtataggtttgaaaggctgtttgaaagaggaatgtttaataaaggctttgatttaatcttga

SEQ ID NO: 442118 - DNA, 1481 bp, Homo sapiens
gcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaagggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccag

SEQ ID NO: 442119 - DNA, 320 bp, Homo sapiens
ctcccttctcttccctgtcaggacaacactcgcatctcctcagccgggtgcctaggggaactgtgtgcctttttgactgaagaggagcttagtgccgttctacagcagtgcttgctgggtaagtacactggagagttccccttcagggacctgggcctctcagccctagcgaagagtcgacgggcatctccctccctccctcagaggatcttttagcaactggactgtcctttccttgggaatccagcagttaaagcaaaatccaggccaggggtggtggcactcacctgtagtcccagctactcaggaggctgaggtgg

SEQ ID NO: 442120 - DNA, 2096 bp, Homo sapiens
catcactaagaagctggatgctggcatttagggcatcccaggctctcctccagaaccacagggctggagtcattgaagaggcggatcaggcccgagaccaggctccgcaggtggctggtgtagtcagcctttgagcgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgatccctgtcagatgaaaatgattcacagctctggcagttcccaagtctggggaggggtataggtttgaaaggctgtttgaaagaggaatgtttaataaaggctttgatttaatcttga

SEQ ID NO: 442121 - DNA, 2526 bp, Homo sapiens
  misc_feature (2362)..(2363): n is a, c, g, or t
  misc_feature (2371)..(2371): n is a, c, g, or t
  misc_feature (2379)..(2379): n is a, c, g, or t
gagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgatccctgtcagatgaaaatgattcacagctctggcagttcccaagtctggggaggggtataggtttgaaaggctgtttgaaagaggaatgtttaataaaggctttgatttaatcttgatataaacagatttttaaaaatctccacccattaaacatgaagcttcctgcatcaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacattgtnncccacttngcccaacncttttttaaattctacaaattattcgaatcggccccaatttggggccaatttgccccaatcccccctaaggtggccccttttacaatccattgcccgttttttacacacggcttaccggcgctctgggtaacccctttcccctttgt

SEQ ID NO: 442122 - DNA, 1145 bp, Homo sapiens
gagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtcccggcttgactggttgttcggcccgggcgggcctggccctcccgggccgggatttggccccgggcgacttgggcccgggattatccggggtccgagaatcccaccggcccggga

SEQ ID NO: 442123 - DNA, 4868 bp, Homo sapiens
  misc_feature (1223)..(1223): n is a, c, g, or t
tcttggttgcataaacatgtttaatgatatagaaaatctattccaaatcaatcattaaaatctaaagcgaaaaatatattacattttaaatgaagggaaaacatctgattttattcaaggttgtggtgactctgttccgcaacttttaaatcaatttaaagttaattcaggtgccttttcaatcattgcagttacacatagggaatactgaaccgaaagatgacaaggcaattgtctgtgtccaaacttaagaaaaactatatttccctggacttttcatcccaacagatttcaaattctcctttccaaggagtatttgaccttcacatttcaggccctgtatctcttcatttcctataccaccatatgttagaaaactcaaactgggctacaagtatatatttctgttaactgactttaatgaattttggttgttttcaaaatctgcgatctgtccattgtgccaaccctgcattgcagggaagtcttagcctgtgattccagcttcgctcctgcaaagatagtcactacaggcaggtttaaattgtatttactcggagagaagagggggaagggaaccccctgccccctgccaacctgacaggccaggctgggtgacaagccccccgggtggctgcacctcccactcgccgacctgggcgctgtccttggtgctgccggcgccatagcgagcacaagcgccttaccttctgcccctgcggaagctgcggacgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacngggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 442124 - DNA, 4622 bp, Homo sapiens
  misc_feature (1223)..(1223): n is a, c, g, or t
tcttggttgcataaacatgtttaatgatatagaaaatctattccaaatcaatcattaaaatctaaagcgaaaaatatattacattttaaatgaagggaaaacatctgattttattcaaggttgtggtgactctgttccgcaacttttaaatcaatttaaagttaattcaggtgccttttcaatcattgcagttacacatagggaatactgaaccgaaagatgacaaggcaattgtctgtgtccaaacttaagaaaaactatatttccctggacttttcatcccaacagatttcaaattctcctttccaaggagtatttgaccttcacatttcaggccctgtatctcttcatttcctataccaccatatgttagaaaactcaaactgggctacaagtatatatttctgttaactgactttaatgaattttggttgttttcaaaatctgcgatctgtccattgtgccaaccctgcattgcagggaagtcttagcctgtgattccagcttcgctcctgcaaagatagtcactacaggcaggtttaaattgtatttactcggagagaagagggggaagggaaccccctgccccctgccaacctgacaggccaggctgggtgacaagccccccgggtggctgcacctcccactcgccgacctgggcgctgtccttggtgctgccggcgccatagcgagcacaagcgccttaccttctgcccctgcggaagctgcggacgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacngggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 442125 - DNA, 2665 bp, Homo sapiens
  misc_feature (91)..(91): n is a, c, g, or t
aagcggcccccttcacttggtactcagacttctccttcctgccatcatgtgaagaagaatgtggcttccccttcctccatgattataagtnacctggggcctcttcagccctgcagaactgagtcagttaaatctctttcctttataaattacccggtctcagactgttccttacaacagcattgagaatggactaatacaagactacagaggaaaaaaaaattatatagctcgtgccgaattcggcacgctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 442126 - DNA, 2513 bp, Homo sapiens
actagttctagctcgcgagcggcctctcgcgatctagaactagcccacgcgtcctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 442127 - DNA, 575 bp, Homo sapiens
catgtttcaccacgacatactggtggttcaaacatgcgcatgtttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaa

SEQ ID NO: 442128 - DNA, 5223 bp, Homo sapiens
  misc_feature (1223)..(1223): n is a, c, g, or t
tcttggttgcataaacatgtttaatgatatagaaaatctattccaaatcaatcattaaaatctaaagcgaaaaatatattacattttaaatgaagggaaaacatctgattttattcaaggttgtggtgactctgttccgcaacttttaaatcaatttaaagttaattcaggtgccttttcaatcattgcagttacacatagggaatactgaaccgaaagatgacaaggcaattgtctgtgtccaaacttaagaaaaactatatttccctggacttttcatcccaacagatttcaaattctcctttccaaggagtatttgaccttcacatttcaggccctgtatctcttcatttcctataccaccatatgttagaaaactcaaactgggctacaagtatatatttctgttaactgactttaatgaattttggttgttttcaaaatctgcgatctgtccattgtgccaaccctgcattgcagggaagtcttagcctgtgattccagcttcgctcctgcaaagatagtcactacaggcaggtttaaattgtatttactcggagagaagagggggaagggaaccccctgccccctgccaacctgacaggccaggctgggtgacaagccccccgggtggctgcacctcccactcgccgacctgggcgctgtccttggtgctgccggcgccatagcgagcacaagcgccttaccttctgcccctgcggaagctgcggacgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacngggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaaaaaaaaaaaaaaaaaaaaaaaaaaaaaaaaaaacaaattcattggccaacctttaacatcgggggggctgggaaaacccaggctttaccaaatttaatcgatttgcagtacattcccctgtcgtcaacatggcgtaagaccggaaaagatcgtgccttgatacgacctttaccaacacttggatccacaactggactgtgctaatgggcgaatttgtaagcggataaaaatttgggctaaaaattcgcgtttcaaaacttttgggataatcctgaaccatgtttttacgccaataggccttctttattaatccatatataaatcaaccagaatagggccgtggggttctttttgc

SEQ ID NO: 442129 - DNA, 4547 bp, Homo sapiens
  misc_feature (1223)..(1223): n is a, c, g, or t
tcttggttgcataaacatgtttaatgatatagaaaatctattccaaatcaatcattaaaatctaaagcgaaaaatatattacattttaaatgaagggaaaacatctgattttattcaaggttgtggtgactctgttccgcaacttttaaatcaatttaaagttaattcaggtgccttttcaatcattgcagttacacatagggaatactgaaccgaaagatgacaaggcaattgtctgtgtccaaacttaagaaaaactatatttccctggacttttcatcccaacagatttcaaattctcctttccaaggagtatttgaccttcacatttcaggccctgtatctcttcatttcctataccaccatatgttagaaaactcaaactgggctacaagtatatatttctgttaactgactttaatgaattttggttgttttcaaaatctgcgatctgtccattgtgccaaccctgcattgcagggaagtcttagcctgtgattccagcttcgctcctgcaaagatagtcactacaggcaggtttaaattgtatttactcggagagaagagggggaagggaaccccctgccccctgccaacctgacaggccaggctgggtgacaagccccccgggtggctgcacctcccactcgccgacctgggcgctgtccttggtgctgccggcgccatagcgagcacaagcgccttaccttctgcccctgcggaagctgcggacgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacngggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacctcgttgacatgcacagtttgcaatcttatgttgatcgatgttaaacgtcacagcagtacttgctcaataaaggtcatattggaaacatagtcaa

SEQ ID NO: 442130 - DNA, 1351 bp, Homo sapiens
cgctgcagtggttgctgggcgaccacggagagaaagccgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 442131 - DNA, 930 bp, Homo sapiens
cgctgcagtggttgctgggcgaccacggagagaaagccgggacttgaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 442132 - DNA, 1373 bp, Homo sapiens
cgctgcagtggttgctgggcgaccacggagagaaagccgggacttgaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattggtatggcaccctccgcccaaaacctttcactctcatccacactctcgaaaaacaaaagcctaagcagatttctcaggcaatttatccacctcctcactctagcaccctccttccaggggaacctaccatgtttaagctagctgagctctctacagtattaccctccctcttatcccacctaccgcactgccccatgcctcttctccatccatccttggcaagggcggtggcacttacattttccagaaaacccactcagccctgaatttctgcatgtccacagctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 442133 - DNA, 1615 bp, Homo sapiens
cgctgcagtggttgctgggcgaccacggagagaaagccgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgtgagagccagactaatggctgaagggggggaaggtgggaagatgggggaacctgaagactacagaaagaggatggagtgatggggtagggaggaggaaaaattagttgacaggagttaaaggagtacacagaatattaagcatttgaagaggcctacaaatcaagtgagcagaaaaacaatgggcaagcccttggtcatgttgaattctgtgaatgacaaagtgctactgcctcaataaccaccctctgcccgtatccaacaggcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 442134 - DNA, 267 bp, Homo sapiens
tctgcatgtccacagctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggtattagctcctcacacatcttgtttaggatgggaagaggctaaaattgtgatgcccaggtctcttcggacagtcctttctttctccccaag

SEQ ID NO: 442135 - DNA, 982 bp, Homo sapiens
cgctgcagtggttgctgggcgaccacggagagaaagccgggacttgaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaaaaaaaaaattttccagagcgggaacgggccaaagggcggaacttaagggggc

SEQ ID NO: 442136 - DNA, 1090 bp, Homo sapiens
cgctgcagtggttgctgggcgaccacggagagaaagccgggacttgaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 442137 - DNA, 1370 bp, Homo sapiens
cgctgcagtggttgctgggcgaccacggagagaaagccgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaagtcctttctttctccccaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 442138 - DNA, 1403 bp, Homo sapiens
cgctgcagtggttgctgggcgaccacggagagaaagccgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaaaaaaaaaattttccagagcgggaacgggccaaagggcggaacttaagggggc

SEQ ID NO: 442139 - DNA, 357 bp, Homo sapiens
acaggaaggggcggaggcctcggtgagaaaggattgcgatattctggaccgggagttgggtccgcggggcggtggagcaacaagctcccctagctccctttgacccactctcccccatccggcccactgcaggtctggttcaagaaccgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggt

SEQ ID NO: 442140 - DNA, 2137 bp, Homo sapiens
atcacctaaacaaccgagcaagacaagccactccgacaaggttggctgcccggcgggtctctgtgagagatccaggtagatggtgaacggccccggcagctgagggcaggccaggcccccagacgcatcagaccctgaaggactgcgtggtgggagccctgcaccgctcctggccccgggccccctggatccgtcggggcgcctccacccagctgttagcatgatgtcttacctcaaacaacccccatacggcatgaacgggctgggcctggccgggcccgccatggacctcctgcacccatccgtgggctatccggccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtctggttcaagaaccgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccattggccgcgcctagcaacacctcgtgtatgcagcgctccgtagctgcaggcgccgccaccgcagcagcctcttatcccatgtcctacggccagggcggcagctacggccaaggctaccctacgccctcctcttcctactttggcggcgtggactgcagctcatacctagcgcccatgcactcacatcaccacccgcaccagctcagccccatggcaccctcctccatggcgggccaccatcatcaccacccacatgcgcaccacccgttgagccagtcctcaggccaccaccaccaccatcaccaccaccaccaccaaggctacggtggctctgggcttgccttcaactctgccgactgcttggattacaaggagcctggcgccgctgctgcttcctccgcctggaaactcaacttcaactcccccgactgtctggactataaggaccaagcctcatggcggttccaggtcttgtgagcccaggaatgaaagaggagaagaaacgcaactacctgcgccctccgtggtcccgatcctgttgctgctgctgcaccgcccgcctttgcctcgtcttctccaaaactgaattttcaccccccaaaaagatgtccattgcctgcactgccgcccccatttttgtgccacttgcttggggggatgtgcaaacccaccctgccccttggatggggggaccggtgcttcggcttggcctacacattctatacaggagagatgtattatttccccccttcagcccctactaaactcttaagcctccccttccagtctttctggacagctattaagcacttgcagccttcggaggctctgcgctctgatccgctgtttgagcccaacactttaatttattctttctggacactggagtcactaactggcgtgtttctgcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgccctgcgctggactggttcaagcttccgcctcggcgggaacgctgtacatagtcaggtccgttccagggaccacttaaactttttagttgctgttggttggttgaactgaacatatcttgtcttagcacccaggaaacagaactttaagatatatacagcacatatatatatatatacatatatatatacacatatat

SEQ ID NO: 442141 - DNA, 2386 bp, Homo sapiens
  misc_feature (249)..(249): n is a, c, g, or t
  misc_feature (1088)..(1088): n is a, c, g, or t
agagctgctgcatccagtgatgtttctgcctacttatctttttgttggcattgttgggtgggatgaattcctaaagaatacaccaagattttctcagtgtttttgttaggagaaggggaagttgagagttaacctcatttatttttcttacagtgtagagataattcagttatgtagcgaaaggacagggctcttaaacagaggaagatagccatgggtgtaggaagattcgtctttgttcagaaatantgtcctctttgcatctctcctaacagttggtgctagcaatcccctactctgtctggcctctggatctagcttgaagttctggattcatttccttcttccttgtacctcagcctgagccttctgtcacccaaagggctccagctggtttttcactcaggcctcactttatcttccaaggtatgtttaggggaagttgtaggcagaattatgtctctcacttccttacttgggcataatgggcagatcctcattaaatattgattggatgaatgttcctagtgaactccctttttaaaaatggtgtttggcagtgggtcggcatttgtttttactcccctctcaccagactgtttgctgtcagacaccttgccatatgtatatggaatgtttttctagttcctagccattttgtaggagtttttaaattatattttttggttgtttcaatgggcagttaggagaaggaggaagtcagatgttttcagttgccatgttcatataggaaactacagattattttaatacttttacaaaattgtattatttcaagacttattgagatgttggtcaagtcttatgctgtaataatacatatatagaaggcagtagtttaaatagcacatttaaaaccagtaatctgggctggacgttgtggcacacacctataatctcaacactttgggaggccaaggcgagtggatcgcttgagctcagaagttcaacaccagcctgggcgacatggcaaaacctcatctatgcagaaaaatacaaaaattagcggactgtgatggtgtatacctgtagtccctgttacttgggaggctgacgtgggaggattncttgagcccaggaggttgaggctgcagtgagctgagatcacgccactgcactccagcctgggcgacagcgagaccctgtctcaaaataaataagtaaaaccagcaatctttgttggtgggtagagattggactgtagtaaaaagagcattagctcataggttggaggattacaattgtaataaaatttttctttttttatgttgagacgttcacaacatgccaacattttttgtccatacgtggcaaccttagtataaattgctgtcagatatcatgtttgtgtattagtcaagagttctccagagatgcagaaccagaaagatacatacacagtcataccttgtttaacgatgggaatacgttctgagaaatgagtcatgaggttattttgtcattgtgtgaacatcagagtgtacttacacaaacctagatggtaaacctgttacacactttgactatatggtatagcctgttgcttctaggctacctgtatagcgtattactgtactgaatagtgtatgcaaatgtaacacagtgatgagtatttgtgtatctaaatgtagaaaagatgcagcaaaattacagtattaaaatctcatgggaccacatttgtttattaggttcattgttggccaaaacataattatgcagcatgtgactatatatagattgattgatagatacataaatacatgagaggggatttattaggggaattgactgatgtgattatgggggctgagaaatcctgtaagaggttgtctgcaaactagagaccctgggatgctggtagtatgattcagtccaagtccaaacgcctcagaaccagagaacccaatggtccaattctcagtctgaggttaaaggcctggctaaagcagggctgctgggctaagtcctggagtcctaaggctagagagcctggagttctgatgtccaagggcaggaggaagagagtatccttgctccaagagagaggcaggggaaatccttttctctccttttttgttctgtcaaggcccctggccggttggatggtgcccacccacactgaggcaaatctgccccactcagtctactgactcacatcctggtctctggaaacaccctcacagacaaacccagaagtaatgttttactggttttctaggtattccttaatccagtcaagttgatacctaaaattaaccatcacagattgcttccccatgcaacaagttgaacataattgaagacatagtagactctctagagaaacttaaaatttgagggcaaataacaaaccccaaactaccta

SEQ ID NO: 442142 - DNA, 567 bp, Homo sapiens
atgtgaagtgtaattgaacagtttttgtcgtcaaaagttttaaaatcttggtcttcatttccagatatcatctcttcttttgatcactgttcctgattgtgacattgtgcaagtgttaaattgtgtgccttttgttcctgaagaaagaggtatggtaaagattgaaatactggagtatatagtctattaagtagtaagttggtatgttttaatattggactaaataaagtaaaatataggttaagtatcccaaatccaaaaatccagaatgcaaaattttttgagtgctgacatgatggtcaaaggaaatgctctttggaacattttggattttgaatttttggatttgagatgctcaactggtataatgcaaatactctaaaatcctaaaaaagaaaaagaaaaaaagaatgaaacccttctgttcccaagcatttcaaataagagacactcaacctgtagttttacatatacatgagttttcataagttatataagttatagttttattttattttttggctaaaataaaatacttaaacatgagttttcattttaatctaagca

SEQ ID NO: 442143 - DNA, 996 bp, Homo sapiens
  misc_feature (778)..(778): n is a, c, g, or t
  misc_feature (780)..(780): n is a, c, g, or t
  misc_feature (785)..(785): n is a, c, g, or t
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcagatatcatctcttcttttgatcactgttcctgattgtgacattgtgcaagtgttaaattgtgtgccttttgttcctgaagaaagaggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaaggaactgagacacagaggttgagacttgtctaaagtaacatgaccagtaagtgcttgaattaatgcagatgaggaaactgaggtccagagaagttgaagttttcccaaggtcacacagcagagctggaactagagcttgcatttcctgacttccagattagtgttatttttacttcaaactattacttcttggngngtatnggggaacatcgtttatcgaagatgggcctaccagtatcgtccggttaatcacgatactcagcgtttcgacaaaagactgggcttcgggaatctgccctggcggcaccgctttggtggtaaacactctttaaaagttcgggacaggcccgtgggggcaaaccaaggctcctcgcccagcgcgggccattccggctgcgggaggcctcccgcg

SEQ ID NO: 442144 - DNA, 371 bp, Homo sapiens
tagtggtagctgtgatttatatggcactttaaaggatatttttacatatattttctcattttatcttcacaacaaccttgtgaaagacataggggaagtactaatttttccccccattttacagatgaaggaactgagacacagaggttgagacttgtctaaagtaacatgaccagtaagtgcttgaattaatgcaggtaggtagtgatgggtatgttctaatctgccaagggcttttccttgctgtcatctggcttgagttctgaggatataaattcatatagccaaaatggtagggaaccagaaaggtaatgagtagatggactttaggactacactagggaaatggtgctgctgttctttttaatttc

SEQ ID NO: 442145 - DNA, 334 bp, Homo sapiens
gcggccgcctactactactactactgctcgaattcaagcttctaacgatgtacggggacatgatggtcaaaggaaatgctctttggaacattttggattttgaatttttggatttgagatgctcaactggtataatgcaaatactctaaaatcctaaaaaagaaaaagaaaaaaagaatgaaacccttctgttcccaagcatttcaaataagagacactcaacctgtagttttacatatacatgagttttcataagttatataagttatagttttattttattttttggctaaaataaaatacttaaacatgagttttcattttaatctaagca

SEQ ID NO: 442146 - DNA, 8049 bp, Homo sapiens
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacaggtattccccgtcagcgggactgcccagaccttttaggatgtcagaacttctagagggccacccagcaggcaaacggcgagtttgtggaccgtcagggtcccccaaacaggtccagggatccgcctcttgtgagaggaagcgcgagttaaatagtcccggccattcagcgcttccgcttaacttgccgcaaagtttttctggagaagtcggggtttttttgccgagcgcttttgccgactgctagagcttacccttactttcttaacctggggttgttttacttccgggctttttgaactctacactctcctacattctaggagctgggtgggagtaggagacggtgtgcctccgcgctccccgcggggcagccgaaccccggaggaaggggcggatcgggcgcggtgtttggggcgaagctgggcgcgcggcgctcgaagcactcactcggcgggtttcgtggttggtggagacagcaagggcgccccgcagaccgcacccctcgagctataggttcgcaggcccgactcgacggcgtccctattgctggcccagcgtatggtcattgggggccatttcttgcagagatgccctgctccctgacgcgctcgctcttctccagagttggccaaaggtgctcttccccgcagaccctaaccacacccagtggcagttggatttctttgtaactggctttctcacatatatcatctcttcttttgatcactgttcctgattgtgacattgtgcaagtgttaaattgtgtgccttttgttcctgaagaaagaggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaaggaactgagacacagaggttgagacttgtctaaagtaacatgaccaatgaggaaactgaggtccagagaagttgaagttttcccaaggtcacacagcagagctggaactagagcttgcatttcctgacttccagattagtgttatttttacttcaaactattacttcttgataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttacgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgttta

SEQ ID NO: 442147 - DNA, 7219 bp, Homo sapiens
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcagatatcatctcttcttttgatcactgttcctgattgtgacattgtgcaagtgttaaattgtgtgccttttgttcctgaagaaagaggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaaggaactgagacacagaggttgagacttgtctaaagtaacatgaccaatgaggaaactgaggtccagagaagttgaagttttcccaaggtcacacagcagagctggaactagagcttgcatttcctgacttccagattagtgttatttttacttcaaactattacttcttgataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttacgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgttta

SEQ ID NO: 442148 - DNA, 6822 bp, Homo sapiens
gcaaatgaaaaagttaatagtatatggataaaccacatgtgtgtaattggaacttcttaggattctaagatttttaaaatcttgtttaaaaactgtattatcaccttaatataaaaatcttagcgcttgagcgtacttacccaactgtggttttctttagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttacgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgttta

SEQ ID NO: 442149 - DNA, 5793 bp, Homo sapiens
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacaggtattccccgtcagcgggactgcccagaccttttaggatgtcagaacttctagagggccacccagcaggcaaacggcgagtttgtggaccgtcagggtcccccaaacaggtccagggatccgcctcttgtgagaggaagcgcgagttaaatagtcccggccattcagcgcttccgcttaacttgccgcaaagtttttctggagaagtcggggtttttttgccgagcgcttttgccgactgctagagcttacccttactttcttaacctggggttgttttacttccgggctttttgaactctacactctcctacattctaggagctgggtgggagtaggagacggtgtgcctccgcgctccccgcggggcagccgaaccccggaggaaggggcggatcgggcgcggtgtttggggcgaagctgggcgcgcggcgctcgaagcactcactcggcgggtttcgtggttggtggagacagcaagggcgccccgcagaccgcacccctcgagctataggttcgcaggcccgactcgacggcgtccctattgctggcccagcgtatggtcattgggggccatttcttgcagagatgccctgctccctgacgcgctcgctcttctccagagttggccaaaggtgctcttccccgcagaccctaaccacacccagtggcagttggatttctttgtaactggctttctcacatatatcatctcttcttttgatcactgttcctgattgtgacattgtgcaagtgttaaattgtgtgccttttgttcctgaagaaagaggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaaggaactgagacacagaggttgagacttgtctaaagtaacatgaccagtaagtgcttgaattaatgcagatgaggaaactgaggtccagagaagttgaagttttcccaaggtcacacagcagagctggaactagagcttgcatttcctgacttccagattagtgttatttttacttcaaactattacttcttgataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgtggcagtgtgcttccgcggaagcacactgcaacattaatgcaaagaaacaagagaacactcagttactttcact

SEQ ID NO: 442150 - DNA, 1985 bp, Homo sapiens
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacaggtattccccgtcagcgggactgcccagaccttttaggatgtcagaacttctagagggccacccagcaggcaaacggcgagtttgtggaccgtcagggtcccccaaacaggtccagggatccgcctcttgtgagaggaagcgcgagttaaatagtcccggccattcagcgcttccgcttaacttgccgcaaagtttttctggagaagtcggggtttttttgccgagcgcttttgccgactgctagagcttacccttactttcttaacctggggttgttttacttccgggctttttgaactctacactctcctacattctaggagctgggtgggagtaggagacggtgtgcctccgcgctccccgcggggcagccgaaccccggaggaaggggcggatcgggcgcggtgtttggggcgaagctgggcgcgcggcgctcgaagcactcactcggcgggtttcgtggttggtggagacagcaagggcgccccgcagaccgcacccctcgagctataggttcgcaggcccgactcgacggcgtccctattgctggcccagcgtatggtcattgggggccatttcttgcagagatgccctgctccctgacgcgctcgctcttctccagagttggccaaaggtgctcttccccgcagaccctaaccacacccagtggcagttggatttctttgtaactggctttctcacatatatcatctcttcttttgatcactgttcctgattgtgacattgtgcaagtgttaaattgtgtgccttttgttcctgaagaaagaggtcctgggatctttgaaatgctaagattcttggataccacagtatcataaaattcctctaaatgcaagtctcgctgtgtcgcccaagctgaagtacagtggcgtgatcccggctcactgccaacctctgccacccgggttcaagtgattctcatgtctcagcctcctgagtagctgggattacaggcacccgcaaccatgcccggctaactttttgtatttttagtacagatggggtttcgccatgttggccaggctgttcttgaactcctaacctcaggtgatccgcccgctttggcctcgcaaagtgttgggattacaagcatgagccaccgctcccagccgtgatttctgacctatgtatgttaacattaccagttccttggctcctcactttttatttggattgtcactctagttgcttaatttcctcatttctatttttactctttctccagtttatcttgctgtctagtacccttctaatatttctaatgtactgcttttataacttttttctgttcttaaattaacaattgcttctgtttacctttcatttccagttcagatctgtcctctatagtctgttctcacttaacctccccatcatgcattctctttttcatctagaccctgtggtaccttaggagaaaaatacttttcttccattgtttctttattctgttcttgtggtttagattgcctttgcttctttcttacatgttttaagtcctgctactctttaaagggtcctcacaaaacctacctttctgtgaagtaaacacagtcatcgt

SEQ ID NO: 442151 - DNA, 1610 bp, Homo sapiens
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacaggtattccccgtcagcgggactgcccagaccttttaggatgtcagaacttctagagggccacccagcaggcaaacggcgagtttgtggaccgtcagggtcccccaaacaggtccagggatccgcctcttgtgagaggaagcgcgagttaaatagtcccggccattcagcgcttccgcttaacttgccgcaaagtttttctggagaagtcggggtttttttgccgagcgcttttgccgactgctagagcttacccttactttcttaacctggggttgttttacttccgggctttttgaactctacactctcctacattctaggagctgggtgggagtaggagacggtgtgcctccgcgctccccgcggggcagccgaaccccggaggaaggggcggatcgggcgcggtgtttggggcgaagctgggcgcgcggcgctcgaagcactcactcggcgggtttcgtggttggtggagacagcaagggcgccccgcagaccgcacccctcgagctataggttcgcaggcccgactcgacggcgtccctattgctggcccagcgtatggtcattgggggccatttcttgcagagatgccctgctccctgacgcgctcgctcttctccagagttggccaaaggtgctcttccccgcagaccctaaccacacccagtggcagttggatttctttgtaactggctttctcacatatatcatctcttcttttgatcactgttcctgattgtgacattgtgcaagtgttaaattgtgtgccttttgttcctgaagaaagaggtatggtaaagattgaaatactggagtatatagtctattaagtagtaagttggtatgttttaatattggactaaataaagtaaaatataggttaagtatcccaaatccaaaaatccagaatgcaaaattttttgagtgctgacatgatggtcaaaggaaatgctctttggaacattttggattttgaatttttggatttgagatgctcaactggtataatgcaaatactctaaaatcctaaaaaagaaaaagaaaaaaagaatgaaacccttctgttcccaagcatttcaaataagagacactcaacctgtagttttacatatacatgagttttcataagttatataagttatagttttattttattttttggctaaaataaaatacttaaacatgagttttcattttaatctaagca

SEQ ID NO: 442152 - DNA, 7316 bp, Homo sapiens
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacagatatcatctcttcttttgatcactgttcctgattgtgacattgtgcaagtgttaaattgtgtgccttttgttcctgaagaaagagatgtctcctactctttgtgttggataggtcctgggatctttgaaatgctaagattcttggataccacagtatcataaaattcctctaaatgcaatgaaggaactgagacacagaggttgagacttgtctaaagtaacatgaccagtaagtgcttgaattaatgcagatgaggaaactgaggtccagagaagttgaagttttcccaaggtcacacagcagagctggaactagagcttgcatttcctgacttccagattagtgttatttttacttcaaactattacttcttggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttacgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgttta

SEQ ID NO: 442153 - DNA, 8293 bp, Homo sapiens
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacaggtattccccgtcagcgggactgcccagaccttttaggatgtcagaacttctagagggccacccagcaggcaaacggcgagtttgtggaccgtcagggtcccccaaacaggtccagggatccgcctcttgtgagaggaagcgcgagttaaatagtcccggccattcagcgcttccgcttaacttgccgcaaagtttttctggagaagtcggggtttttttgccgagcgcttttgccgactgctagagcttacccttactttcttaacctggggttgttttacttccgggctttttgaactctacactctcctacattctaggagctgggtgggagtaggagacggtgtgcctccgcgctccccgcggggcagccgaaccccggaggaaggggcggatcgggcgcggtgtttggggcgaagctgggcgcgcggcgctcgaagcactcactcggcgggtttcgtggttggtggagacagcaagggcgccccgcagaccgcacccctcgagctataggttcgcaggcccgactcgacggcgtccctattgctggcccagcgtatggtcattgggggccatttcttgcagagatgccctgctccctgacgcgctcgctcttctccagagttggccaaaggtgctcttccccgcagaccctaaccacacccagtggcagttggatttctttgtaactggctttctcacatatatcatctcttcttttgatcactgttcctgattgtgacattgtgcaagtgttaaattgtgtgccttttgttcctgaagaaagaggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaaggaactgagacacagaggttgagacttgtctaaagtaacatgaccagtaagtgcttgaattaatgcagatgaggaaactgaggtccagagaagttgaagttttcccaaggtcacacagcagagctggaactagagcttgcatttcctgacttccagattagtgttatttttacttcaaactattacttcttgataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttacgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgtttaaaaaaaaaaaaaaacaaaaaaaaaaaaaaaaaaaaaaaaaaaaaaaaaaacaaagaaaaaacagaaagaggaggccgccaataaataatatttactaacagagggacacatagactataacagtcgacaccagctcattttttgactaaagatggtgcccaatatatacgcgcccgatattactcaagcagacgcgcgaccggtatgaatacatcgacagat

SEQ ID NO: 442154 - DNA, 9059 bp, Homo sapiens
gagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacaggtattccccgtcagcgggactgcccagaccttttaggatgtcagaacttctagagggccacccagcaggcaaacggcgagtttgtggaccgtcagggtcccccaaacaggtccagggatccgcctcttgtgagaggaagcgcgagttaaatagtcccggccattcagcgcttccgcttaacttgccgcaaagtttttctggagaagtcggggtttttttgccgagcgcttttgccgactgctagagcttacccttactttcttaacctggggttgttttacttccgggctttttgaactctacactctcctacattctaggagctgggtgggagtaggagacggtgtgcctccgcgctccccgcggggcagccgaaccccggaggaaggggcggatcgggcgcggtgtttggggcgaagctgggcgcgcggcgctcgaagcactcactcggcgggtttcgtggttggtggagacagcaagggcgccccgcagaccgcacccctcgagctataggttcgcaggcccgactcgacggcgtccctattgctggcccagcgtatggtcattgggggccatttcttgcagagatgccctgctccctgacgcgctcgctcttctccagagttggccaaaggtgctcttccccgcagaccctaaccacacccagtggcagttggatttctttgtaactggctttctcacatatatcatctcttcttttgatcactgttcctgattgtgacattgtgcaagtgttaaattgtgtgccttttgttcctgaagaaagaggtcctgggatctttgaaatgctaagattcttggataccacagtatcataaaattcctctaaatgcattggtgctagcaatcccctactctgtctggcctctggatctagcttgaagttctggattcatttccttcttccttgtacctcagcctgagccttctgtcacccaaagggctccagctggtttttcactcaggcctcactttatcttccaagatgaaggaactgagacacagaggttgagacttgtctaaagtaacatgaccagtaagtgcttgaattaatgcagatgaggaaactgaggtccagagaagttgaagttttcccaaggtcacacagcagagctggaactagagcttgcatttcctgacttccagattagtgttatttttacttcaaactattacttcttgataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtattaggtaccaccattaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtcctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttacgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgtttacacaataatttttttactgtgctaaaatctgatggaaattttgttctctaggaaatacagattttaaagtgtatgtgttttttcaatgctagttaactctacaagatagataaaagtgtgggattttttttcttcccaaaatcatagatgatatattgtttaagaaaggtaacatataccataattttactatggttatgctggcaaggtgagccatagagaggcttatagtcttcagtaccctaacagcaataaaattaaaatgctctgtttgttacatatagatctgttatgagacatcacctgctgtaaatagcaaggagagagaaggaactttcctgctaatattcgcagcactataacattacatttcagaatagccatatcaggaaaataatgtcgagatatgtacttcttgcctttaagttttaacagccatttaaagtaagctttgtgctccagatattctagttggaactttttctgattttaaaagcctgtatcctttattttttgtgtgtggctttccaaagagggctttccaaaatatgattttcagtagttcgaggttcttattacaattgaagagttagttttagttttgcagttgaatttctgtgtgaggaatttgttttattttttctagtttgtccatctccactgaaatgggtttcttactatttggcaagtacttaaaaaacataattcagttttcaaagaatttatcttgctaagtattcagtaacacaaattgaaatgtaatagtttttttaatggaaaatattttcattggggggttagcaaattttttcaataaagggtcagataaataagcttcgtaggccttctagtttctgtcctaactactcaattctcataatgcagaaaaaaaccatagacaatatgtaaatgaattagtgtggctatgttttaataaaacaatttataaaaacaggaagtgggctgaatttggcccaccagacatagt

SEQ ID NO: 442155 - DNA, 112 bp, Homo sapiens
gtgatccacctgcctcggcctcccaaagtgctgggattacaggtgtgagccacagcgcccagccttatggactgtttatgtgatcagtaagctcccggtcagcagtacgctg

SEQ ID NO: 442156 - DNA, 3791 bp, Homo sapiens
ggcacgagtttttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactgtggtccttcatccccccaatctcccgtacctggcgagtccagctcgtcgcggataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctgcttcaaggactgagtccctagtcgaattcccggaaggagtggagcctgtcatattggtgagggtttgccttgaatgtcatcccagtatttcaatattgattaattagtcttccctcatggtcccaactgcatagtttttattttgttgagtgttctgacacatggtaagggacatgaaagtatcctttgagataatctttccattcatcagtgtttatctagcatctgctcaagagtgtgctgcagtggagggaaatcagatgacctcccagtctggttgtgttacatacaatcatgtgtaagaagtgccattcaagccgtgtcactggaggggactgacagtgagtgagtgtggatagagaggacctcctggggtgggcaatgtgagccctcagactctgtaggtattgcattttgcagtgaacactggtagacatgttttgtggctcaagccagcatgtgtgtgatggtttaggattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcctttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaaccgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaatcattcagtctgttattttgtacagcaaccctaggaaactaatactgtgaggaacttgggaaaagctttagatcaagcttgtccaacccgcaggccaggatggctttgaatgcagaccaacacaaatttttaagctttcttcaaacataataaatttagggttgatgcataataatttagggttgaagtcctcgagaac

SEQ ID NO: 442157 - DNA, 3372 bp, Homo sapiens
ggcacgagtttttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactgtggtccttcatccccccaatctcccgtacctggcgagtccagctcgtcgcggataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctgcttcaaggactgagtccctagtcgaattcccggaaggagtggagcctgtcatattggattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcctttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaaccgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaatcattcagtctgttattttgtacagcaaccctaggaaactaatactgtgaggaacttgggaaaagctttagatcaagcttgtccaacccgcaggccaggatggctttgaatgcagaccaacacaaatttttaagctttcttcaaacataataaatttagggttgatgcataataatttagggttgaagtcctcgagaac

SEQ ID NO: 442158 - DNA, 2375 bp, Homo sapiens
  misc_feature (32)..(32): n is a, c, g, or t
cggtacctgaacattcgtgtcctgggggagcnacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcctttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaaccgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaatcattcagtctgttattttgtacagcaaccctaggaaactaatactgtgaggaacttgggaaaagctttagatcaagcttgtccaacccgcaggccaggatggctttgaatgcagaccaacacaaatttttaagctttcttcaaacataataaatttagggttgatgcataataatttagggttgaagtcctcgagaac

SEQ ID NO: 442159 - DNA, 998 bp, Homo sapiens
  misc_feature (7)..(7): n is a, c, g, or t
ccttccnacatctcatccccgagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaaccgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaatcattcagtctgttattttgtacagcaaccctaggaaactaatactgtgaggaacttgggaaaagctttagatcaagcttgtccaacccgcaggccaggatggctttgaatgcagaccaacacaaatttttaagctttcttcaaacataataaatttagggttgatgcataataatttagggttgaagtcctcgagaac

SEQ ID NO: 442160 - DNA, 693 bp, Homo sapiens
ggcacgagtttttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactgtggtccttcatccccccaatctcccgtacctggcgagtccagctcgtcgcggcctgtacctccccacagagcttcaaaacgggcttttaggaagaaggaatggaggctttgaagcaatgctaagaaaagagtgatatgcaagctgagaccaaaaatatggtatgatttagccatactgaaggggaaggaaataagagctgggcaaagcattctgtgaattggctgactccacttctatggtgagagagaggagtgcatcaaagattactcccagtagagatggtttcagcatgttggccagtctggtctcagactcctgacctcaagtgatccacccacctcggcctcccaaaatgctgggattacaggtataagccactgtgcctggccaaag

SEQ ID NO: 442161 - DNA, 3767 bp, Homo sapiens
ggcacgagtttttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactgtggtccttcatccccccaatctcccgtacctggcgagtccagctcgtcgcggataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctgcttcaaggactgagtccctagtcgaattcccggaaggagtggagcctgtcatattggtgagggtttgccttgaatgtcatcccagtatttcaatattgattaattagtcttccctcatggtcccaactgcatagtttttattttgttgagtgttctgacacatggtaagggacatgaaagtatcctttgagataatctttccattcatcagtgtttatctagcatctgctcaagagtgtgctgcagtggagggaaatcagatgacctcccagtctggttgtgttacatacaatcatgtgtaagaagtgccattcaagccgtgtcactggaggggactgacagtgagtgagtgtggatagagaggacctcctggggtgggcaatgtgagccctcagactctgtaggtattgcattttgcagtgaacactggtagacatgttttgtggctcaagccagcatgtgtgtgatggtttaggattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcctttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaaccgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggttaaatcattcagtctgttattttgtacagcaaccctaggaaactaatactgtgaggaacttgggaaaagctttagatcaagcttgtccaacccgcaggccaggatggctttgaatgcagaccaacacaaatttttaagctttcttcaaacataataaaatttttttgtgattaaaattt

SEQ ID NO: 442162 - DNA, 3590 bp, Homo sapiens
ggcacgagtttttttcttcctggtggcgtttgggcttaatacagctttggcgaggtcggatgacgggtgggagccagcggtggaaggggtggcgaaagtaccggtttgccccaggccgccgaggggcctccttagagagaccttgcctgctccgctcgcgtccgccggggccgcgcgggtcctcctggcgccgccaggttcaaaaagccactcgagttgtcactgcgacggccctgggccaggagccgtttcgggatctgtcaaacaacgagttttcgtcgttcgaatcaggttgactgtggtccttcatccccccaatctcccgtacctggcgagtccagctcgtcgcggataccgttaaccctggataaagagaatggaggttacctctgtccgtgtagattcctaagctgtcctggagtgatccttggagtaaaggaaaggtgctttgaagcacattcagccatcagccctgtgggatggcagccactgatttgtcctatggtctttacagggacccagtctgccttcaagaaaagacagaagtagaaagggtggtggctgactgtctgacaaattgttatcaggtatgcaggaagtatatccttctccaaaatatcatacttgcatcaccaggtagacacatttccttctacacagaattatcttcagagcttcttaaagcaaataaagcctgcttcaaggactgagtccctagtcgaattcccggaaggagtggagcctgtcatattggtgagggtttgccttgaatgtcatcccagtatttcaatattgattaattagtcttccctcatggtcccaactgcatagtttttattttgttgagtgttctgacacatggtaagggacatgaaagtatcctttgagataatctttccattcatcagtgtttatctagcatctgctcaagagtgtgctgcagtggagggaaatcagatgacctcccagtctggttgtgttacatacaatcatgtgtaagaagtgccattcaagccgtgtcactggaggggactgacagtgagtgagtgtggatagagaggacctcctggggtgggcaatgtgagccctcagactctgtaggtattgcattttgcagtgaacactggtagacatgttttgtggctcaagccagcatgtgtgtgatggtttaggattcagtgacttttgatgatctggctgtggacttcaccccagaagaatggactttactggacccaactcagagaaacctctacagagatgtgatgctggagaactacaagaatttggccacagtaggatatcagctcttcaaacccagtctgatctcttggctggaacaagaagagtctaggacagtgcagagaggtgatttccaagcttcagaatggaaagtgcaacttaaaaccaaagagttagcccttcagcaggatgttttgggggagccaacctccagtgggattcaaatgataggaagccacaacggaggggaggtcagtgatgttaagcaatgtggagatgtctccagtgaacactcatgccttaagacacatgtgagaactcaaaatagtgagaacacatttgagtgttatctgtatggagtagacttccttactctgcacaagaaaacctctactggagagcaacgttctgtatttagtcagtgtggaaaagccttcagcctgaacccagatgttgtttgccagagaacgtgcacaggagagaaagcttttgattgcagtgactctgggaaatccttcattaatcattcacaccttcagggacatttaagaactcacaatggagaaagtctccatgaatggaaggaatgtgggagaggctttattcactccacagaccttgctgtgcgtatacaaactcacaggtcagaaaaaccctacaaatgtaaggaatgtggaaaaggatttagatattctgcataccttaatattcacatgggaacccacactggagacaatccctatgagtgtaaggagtgtgggaaagccttcaccaggtcttgtcaacttactcagcacagaaaaactcacactggagagaaaccttataaatgtaaggattgtgggagagccttcactgtttcctcttgcttaagtcaacatatgaaaatccatgtgggtgagaagccttatgaatgcaaggaatgtgggatagccttcactagatcttctcaacttactgaacatttaaaaactcacactgcaaaggatccctttgaatgtaagatatgtggaaaatcctttagaaattcctcatgcctcagtgatcactttcgaattcacactggaataaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcctttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaactcactggggagaaaccctatgaatgtaaaaatgtggaagcaactttgtatctcaggtcttaatgaacacatatgaattcacagtggagaagaccctgcatcagggaatgtggaaatgactttgctgaattctcaagccttaccaaacacatcagaaatctcactggagagaaaccgtatgaatgtagagaatctgggaatacctttctgaatcccacaaaccttaatgtgtgtatgtgaactcacattggagagaaaccctgcaatttaaatggtatggtctggatgatgccccactccatatttgtaagccctaagtcctagttccttacactataactgtatttggacatagggttttcaaacaggtgagtaacttcaaatgaggttgttgggttcgatccctaatctgacatcactggtgtccctataagggaaactgaaggaaggatacacatggagaagactgtgtggatccaccagaagatggccatctacaagccaaggacagagacctggaacagatgctttcattatggcctccagaggaaaccaaccctgtctccaccttgatattgcacttccaggctccagaactgtgaggcaataaatttctcttggtta

SEQ ID NO: 442163 - DNA, 1039 bp, Homo sapiens
tgtcttcaattctgtctggtggaacaaaggtttatttgttgtaggttttttttacatcagttacattgaccatccattcatagtagcacatacacagtggtgaaactaagatgtgttgggatattcactagtgtcctatagatagaaaataaatgtatatttaccagggcctcatccagaccatggtcatactcgagtcagcatgttgtgtcagttacctgacagtggttatgaatgatcctcagggctcttgtctccatctccaggatcccaggagggcactcatggtggtttatgggactctggactcctgagaagcggccttgagtctacaggatacatctacagcctgacctgaccacccgacactcccaggcagccgcggcttgctcccctgctggccatttccagcctgctagaaaacccacctttttgttcctaccgaccgtggctttgagatcaagtgagggtaggaaatgcccctggtcactaaaagggctgtaggaaaggctggctctctgagaatacagctgccctccagggcaggacctggaaggagcacagcgccagggcgacacatggtcacaagcccagctctgtccctgagcagcgtgctctctgcttggggtctctcctgaccgtctctgcaaggcgtggggagagacctgctgctccctttgaatgctttcttccacatgtggacaaatggcccttcccttccttccccgtaacacagcccacggaaatattgaagacatgccactaagtgactttccaagtgggacatcaaagaactgggcttctaccctgagcagcatcttgctgtggacctcaagtaagtcaccccatcatttatgcctcaccttcctcatctgtaaaatgtgaggagagccaggcaccgtggcgcacgcctgtagtcccagctactcacgaggccgaggcaggaggatcgcttaagcctgggagttaaaggctgcaatgagctatgattgcaccactgcactccagcctgggcaacagagtgaaaactcatctctaa

SEQ ID NO: 442164 - DNA, 566 bp, Homo sapiens
agctcactgtaatctcaacctcaaactcctgtgctcaggaggctgaggtaggatcacctgagcctgggacattgaggctgcagtgagccacgactgcaccactgcactgcagcctgggtgacagagcaaagccctgtggaaaaaaaaaaaaagtgcctcagagggcattaaagatccactctgccctggctcctttctttcctgctggttcagctctccccactcctgtgaccatttgggaggtgccagggctgcagtgccgtgggtgcctgaccaggggtacccaaccagggttgcagccacaggaatcctcatggtttccagggaacacaagggaattttctttctttgcctttagtaataataactgaacatggaccaggtgccagggatcatgacaaatgctgaaaccacgtgtcctcattgaagccccagccagccacccctgggagtcatttgggtgtccttgtcccccggtctgtactctaatgtctcttcacacttgctcttaatctgagtatttgaaattaaaagtactatgtatacaaaacaaagttcttcatgag

SEQ ID NO: 442165 - DNA, 966 bp, Homo sapiens
ggtgggcggggcttcgcgtctccttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccacaacccgcggccagccccacgtggtgccgctcagccttctctgcccctcctgggaatctgtcattcgtgggtgcttcagagtaaaatcaatgagtttctgagcagaatga

SEQ ID NO: 442166 - DNA, 2126 bp, Homo sapiens
ggtgaatcggccgaggcttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccacaacccgcggccagccccacgtggtgccgctcagccttctctgcccctcctgggaatctgtcattcgtgggtgcttcagagtaaaatcaatgagtttctgagcagaatgagtgagtgatctagtttctataaattaggcatgctttatacattatgtttgtgtagaaaatccctggtttaatatttttactttatgcctatctgattgttgaagtttttatgagactatattagtttttgggccaggtgcggtggctcatgcctgtaatcccagcactttgggaggccgaggtgggcggatcactttaggttcggaattcaagtccagcctgaccaacatgatgaaaccctgtctctactaaaaatacaaaaatcagctggcacgcgccgccacacccagctaatgtttgtatttttagtagagacggggtttcaccacattggccaagatggtctccatctcctgacctcgtgatccacccaccgcgccctcccagaatgctgggattacaggcgtgagccaccgcgccgagcctgcaaaagcctaaactcttttttgtggcattacttgttacatggtttctacatctgcgtttgcctttttgtaagttctctgatcccaaactgtttatattctgtgggactgtgtatagagtgatacttaataaacagcagttttagttttttggtttttatgagataggctcttaccatgtggcccaagtagtgtcaaactcctgaggtcaagtgatcctccctacttagtctcctcagagactacagtcatgcactgcccagcccagcaataatgttgttggtgtttttagatacaggagcaaagccctgtggaaaaaaaaaaaaagtgcctcagagggcattaaagatccactctgccctggctcctttctttcctgctggttcagctctccccactcctgtgaccatttgggaggtgccagggctgcagtgccgtgggtgcctgaccaggggtacccaaccagggttgcagccacaggaatcctcatggtttccagggaacacaagggaattttctttctttgcctttagtaataataactgaacatggaccaggtgccagggatcatgacaaatgctgaaaccacgtgtcctcattgaagccccagccagccacccctgggagtcatttgggtgtccttgtcccccggtctgtactctaatgtctcttcacacttgctcttaatctgagtatttgaaattaaaagtactatgtatacaaaacaaagttcttcatgag

SEQ ID NO: 442167 - DNA, 1733 bp, Homo sapiens
ggtgaatcggccgaggcttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccacaacccgcggccagccccacgtggtgccgctcagccttctctgcccctcctgggaatctgtcattcgtgggtgcttcagagtaaaatcaatgagtttctgagcagaatgagatcccaggagggcactcatggtggtttatgggactctggactcctgagaagcggccttgagtctacaggatacatctacagcctgacctgaccacccgacactcccaggcagccgcggcttgctcccctgctggccatttccagcctgctagaaaacccacctttttgttcctaccgaccgtggctttgagatcaagtgagggtaggaaatgcccctggtcactaaaagggctgtaggaaaggctggctctctgagaatacagctgccctccagggcaggacctggaaggagcacagcgccagggcgacacatggtcacaagcccagctctgtccctgagcagcgtgctctctgcttggggtctctcctgaccgtctctgcaaggcgtggggagagacctgctgctccctttgaatgctttcttccacatgtggacaaatggcccttcccttccttccccgtaacacagcccacggaaatattgaagacatgccactaagtgactttccaagtgggacatcaaagaactgggcttctaccctgagcagcatcttgctgtggacctcaagtaagtcaccccatcatttatgcctcaccttcctcatctgtaaaatgtgaggagagccaggcaccgtggcgcacgcctgtagtcccagctactcacgaggccgaggcaggaggatcgcttaagcctgggagttaaaggctgcaatgagctatgattgcaccactgcactccagcctgggcaacagagtgaaaactcatctctaa

SEQ ID NO: 442168 - DNA, 905 bp, Homo sapiens
ggtgaatcggccgaggcttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccacaacccgcggccagccccacgtggtgccgctcagccttctctgcccctcctgggaatctgtcattcgtgggtgcttcagagtaaaatcaatgagtttctgagcagaatga

SEQ ID NO: 442169 - DNA, 557 bp, Homo sapiens
ggtgaatcggccgaggcttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccacaacccgcggccagccccacgtggtgccgctcagccttctctgcccctcctgggaatctgtcattcgtgggtgcttcagagtaaaatcaatgagtttctgagcagaatga

SEQ ID NO: 442170 - DNA, 400 bp, Homo sapiens
gcaccagctagagtagtaaactccatcgggcccttcttcccctcagtgctgttgctgattctggtttttaatcaagagctgttaaaatgtagttcttcccaagtcgacactatgttcttgaatcactgccattaagggagattcacgtttctttcagatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtct

SEQ ID NO: 442171 - DNA, 960 bp, Homo sapiens
ggtgaatcggccgaggcttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccacaacccgcggccagccccacgtggtgccgctcagccttctctgcccctcctgggaatctgtcattcgtgggtgcttcagagtaaaatcaatgagtttctgagcagaatga

SEQ ID NO: 442172 - DNA, 2677 bp, Homo sapiens
ggtgaatcggccgaggcttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccacaacccgcggccagccccacgtggtgccgctcagccttctctgcccctcctgggaatctgtcattcgtgggtgcttcagagtaaaatcaatgagtttctgagcagaatgagtgagtgatctagtttctataaattaggcatgctttatacattatgtttgtgtagaaaatccctggtttaatatttttactttatgcctatctgattgttgaagtttttatgagactatattagtttttgggccaggtgcggtggctcatgcctgtaatcccagcactttgggaggccgaggtgggcggatcactttaggttcggaattcaagtccagcctgaccaacatgatgaaaccctgtctctactaaaaatacaaaaatcagctggcgtggtggcgcgtgcctgcaatctcagctacttgagaggctgaggcaggagaatggcttgaaccgggaggcagaggctgctgtgagccattgcactccagcctgggcgacagagtgagacttcgtcttaaataataagatcccatggagttaaaatgaagtttgacatcatgaaaatgaaaataacctacaaaaaaattgccgctgtttgcatactggggacatggcaagcgatgtaaactgccttccctggcattcttctgacacaaatcctcgagtttcacaatgtttgcagccatttccagagttaacatactaggttagaatgagggaaaggtgacagttttgaaacagaccgaagagactggccaaaagctagggcatggggagaatgtgaaggtatgcaaaagcctacttttttttttttttaatggagtctcgctctgtcaccaggctggtgtgcagtggcacgatgtaagctcactgcaacctccgcctcctgggttcaggcgattctcatgcctcagcctccagagtagttgggactacaggcacgcgccgccacacccagctaatgtttgtatttttagtagagacggggtttcaccacattggccaagatggtctccatctcctgacctcgtgatccacccaccgcgccctcccagaatgctgggattacaggcgtgagccaccgcgccgagcctgcaaaagcctaaactcttttttgtggcattacttgttacatggtttctacatctgcgtttgcctttttgtaagttctctgatcccaaactgtttatattctgtgggactgtgtatagagtgatacttaataaacagcagttttagttttttggtttttatgagataggctcttaccatgtggcccaagtagtgtcaaactcctgaggtcaagtgatcctccctacttagtctcctcagagactacagtcatgcactgcccagcccagcaataatgttgttggtgtttttagatacaggagcaaagccctgtggaaaaaaaaaaaaagtgcctcagagggcattaaagatccactctgccctggctcctttctttcctgctggttcagctctccccactcctgtgaccatttgggaggtgccagggctgcagtgccgtgggtgcctgaccaggggtacccaaccagggttgcagccacaggaatcctcatggtttccagggaacacaagggaattttctttctttgcctttagtaataataactgaacatggaccaggtgccagggatcatgacaaatgctgaaaccacgtgtcctcattgaagccccagccagccacccctgggagtcatttgggtgtccttgtcccccggtctgtactctaatgtctcttcacacttgctcttaatctgagtatttgaaattaaaagtactatgtatacaaaacaaagttcttcatgag

SEQ ID NO: 442173 - DNA, 1041 bp, Homo sapiens
ggtgaatcggccgaggcttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccacaacccgcggccagccccacgtggtgccgctcagccttctctgcccctcctgggaatctgtcattcgtgggtgcttcagagtaaaatcaatgagtttctgagcagaatgaaaaaaaaaaacaaagggggggcgcaaaaaataccccagaggggcccaatacaggataccggattttggcacaaaggggccc

SEQ ID NO: 442174 - DNA, 913 bp, Homo sapiens
ggtgaatcggccgaggcttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttcttggggtcttctggccagagcttgtcaccagccccatggcctctccaggcgtgctcatgcccctcctgggaatctgtcattcgtgggtgcttcagagtaaaatcaatgagtttctgagcagaatga

SEQ ID NO: 442175 - DNA, 1538 bp, Homo sapiens
cgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgt

SEQ ID NO: 442176 - DNA, 2082 bp, Homo sapiens
aacaatgagcccaagtttaaagcagtctaattaacctggacaagctcaggcaagtttcattctgtggcccatagcatcatctgtgttgtaaagctaagtagcaaatgttgtttgggtcatgctgggggacaagccatcccaatttgctcaggactgaggggttttccaggatatcatgtaaggataattgggtacaaatataacctgctgctttctctcatttcaaatttatcatttatcatatcagcaactatgagttatgttttttattagatttcttgttactttttccccagaccacttcccatgaaattaatatactattatcactctccagatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaa

SEQ ID NO: 442177 - DNA, 1417 bp, Homo sapiens
ctagaatttatcctcattttacagtagagaaaacagagggtcaagaagataatgtaaatgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaa

SEQ ID NO: 442178 - DNA, 851 bp, Homo sapiens
cgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataaca

SEQ ID NO: 442179 - DNA, 2647 bp, Homo sapiens
cgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaa

SEQ ID NO: 442180 - DNA, 407 bp, Homo sapiens
gaaacaaaaggcctgagtgacttgactgtgggtttaacttgggggagggggtgcatgataacagaaatgtgagtgctcatcaccactttttctttggaatgtcttcttataacaaaaagatataaatagcataaagtgagctttaggagccacaagttgtagtacactttaagtgaatttatatatacacagaatagttttcaaaaggtcagatgataacatatgtttgtacttgtgaaattttgcaagacagcatttgagagcaaaagagaaaatctcggctttgctgaccacaagaggccatctatgttcttcattattttgtttcactgagtgaactgtgcaaggttcattgttgctggaactttcagaataaaagttgggacagacgcctctgctctctcgag

SEQ ID NO: 442181 - DNA, 10815 bp, Homo sapiens
  misc_feature (5850)..(5850): n is a, c, g, or t
catcatgcagcaggtcaaacaaggcatctcctagtattgcatcctacagatgtgctgtaaacatcaaaagaagacggtgggatcaggagatgctgttttggaaagaagtgaggtttagacttctccatgttaaccatgagcgtgacactttcccccctgaggtcacaggacctggatcccatggctactgatgcttcacccatggccatcaacatgacacccactgtggagcagggtgagggagaagaggcaatgaaggacatggactctgaccagcagtatgaaaagccacccccactacacacaggggctgactggaagattgtcctccacttacctgaaattgagacctggctccggatgacctcagagagggtccgagacctaacctattcagtccagcaggattcggacagcaagcatgtggatgtacatctagttcaactaaaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagcttatccgaagtgttggtttacttacggtagctgctgactctatctctaccaatggcagtgaagcagttactgaggaggtatctcaagtatctctctcagtagacgacaaaggtggatgtgaggaagacaatgcttctgcagtcgaagagcaaccaggcttaacactgggggtgtcatcatcttcaggagaagctctgacaaatgctgctcaaccctcctctgagactgtgcagcaagaatccagttcctcctcccatcatgatgcaaagaatcagcagcctgttccttgtgaaaatgcaacccccaaacgaaccatcagagattgctttaattataacgaggactctcccacgcagcctacattgccaaaaagaggactttttcttaaagaggaaacttttaagaatgatctgaaaggcaatggtggaaagaggcaaatggttgatctaaagcctgagatgagcagaagcaccccttcgctagtagatcctcctgacagatccaaactttgcctggtattgcagtcttcttaccccaacagcccttctgctgccagccagtcttatgagtgtttacacaaggtggggaatgggaaccttgaaaacacagtcaaatttcacattaaagaaatttcttccagcctgggaaggcttaacgactgctataaagagaaatctcgacttaaaaagccacacaagacctcagaagaggtgcctccatgccgaacacctaaacgggggactggttcaggcaaacaagctaaaaatacaaagagctcagcagtgccaaatggagagctttcttatacttccaaggccatagaggggccacaaacaaattctgcttccacatcctcacttgagccttgtaatcagagaagttggaatgccaaattgcaattgcagtcagaaacatccagttcaccagcttttactcagagcagtgaatcctctgttggctcagacaacatcatgtctccggtgccacttctttcaaaacacaaaagcaaaaaaggtcaagcctcctctccaagtcacgtcactaggaatggtgaggttgtggaggcctggtatggctctgatgaatacctagcactgccctctcaccttaagcagacagaagtattggctttgaagttggaaaacctaacaaagcttctgcctcagaaacccagaggagaaaccatccagaatattgatgactgggaactgtctgaaatgaattcagattctgaaatctatccaacctatcatgtcaaaaagaagcatacaaggctaggcagggtgtctccaagctcatctagtgacatagcctcttcactaggggagagcattgaatctgggcccctgagtgacattctttctgatgaggagtccagtatgcctctcgctggcatgaaaaagtatgctgatgagaagtcagaaagagcttcatcctctgagaaaaatgagagccattctgccactaaatcagctttaattcagaaactgatgcaagatattcagcaccaagacaactatgaagccatatgggaaaaaatagaggggtttgtaaacaaactggatgaattcattcaatggttaaatgaagccatggaaactacagagaattggactccccctaaagcagagatggatgaccttaaactgtatctggagacacacttgagttttaagttgaatgtagacagtcattgtgctctcaaggaagctgtggaggaggaaggacaccaacttcttgagcttattgcatctcacaaagcaggactgaaggacatgctgcggatgattgcaagtcaatggaaggagctgcagaggcaaatcaaacggcagcacagctggattctcagggctctggataccatcaaagccgagatactggctactgatgtgtctgtggaggatgaggaagggactggaagccccaaggctgaggttcaactatgctacctggaagcacaaagagatgctgttgagcagatgtccctcaagctgtacagcgagcagtataccagcagcagcaagcgaaaggaagagtttgctgatatgtcaaaagttcattcagtgggaagcaatgggcttctggactttgattcagaatatcaggagctctgggattggctgattgacatggagtcccttgtgatggacagccacgacctgatgatgtcagaggagcagcagcagcatctttacaagcgatacagtgtggaaatgtccatcagacacctgaaaaagacggagctgcttagtaaggttgaagctttgaagaaaggtggcgttttactaccaaatgatctccttgaaaaagtggattcaattaatgaaaaatgggaactgcttgggaaaaccctaggagagaagatccaggacacaatggcagggcacagtgggtcgagtccacgtgacctgctctctcctgaaagtggaagcctggtaaggcagctggaggtcaggatcaaagaactgaaaggatggctaagagatacagagcttttcatcttcaattcctgtctgagacaagaaaaggaaggaacaatgaatactgagaaacaactgcaatactttaagtccctctgtcgtgaaatcaagcaacgacgtcgaggagttgcctccattctgcgactatgccagcatcttttggatgaccgggagacttgcaatctgaatgcagaccaccagcccatgcagctgatcattgtaaatcttgaaagaaggtgggaagccattgtcatgcaagccgtccagtggcaaacacgtctacaaaagaagatgggaaaggaatctgagactttgaatgtgattgatcctggcttgatggacctaaatgggatgagtgaggatgccctggaatgggatgaaatggacataagtaacaagttaattagtttgaatgaggaatcaaatgaccttgatcaagaactccaacctgttatcccttccttgaagcttggagagacaagtaatgaggaccctggttatgacgaggaggctgataaccatgggggatctcagtatgcctcaaatattactgccccctctagtccacacatttaccaggtgtacagcctccacaatgttgaactctatgaggacaaccacatgccatttctgaaaaacaatccaaaggtcactggcatgacacagcctaatgttttaactaagagtctcagtaaagactcttcattttcatctaccaaatctttgccagatcttctaggtggttccaatttggtaaagccctgcgcatgtcatggaggagacatgagccagaattcaggcagtgagagtggaattgtcagtgaaggagacacagaaaccactaccaactctgaaatgtgcttgctcaatgcagtggatgggtccccaagtaaccttgaaactgaacatctggacccacaaatgggagatgcagttaacgtgttaaagcaaaaatttacagatgagggggaaagcattaagcttccaaatagctctcagtcgtccatttcaccagtgggttgtgtaaatggaaaagttggagatttaaacagtattaccaaacatacccctgactgtttgggagaagaattacaaggaaaacatgatgtgtttacattttatgattactcatacctccaaggctcaaaactcaaattaccaatgataatgaaacagtcacaaagcgaaaaagcgcatgtggaggatcccctgcttcgtggtttttattttgataaaaaatcatgcaaatctaaacatcagactacagagttacaaccagatgtacctccccatgaaaggattttggcaagtgcatctcatgaaatggatcgcatttcatataaaagtggcaatatagaaaagacattcactggcatgcagaatgccaaacagctctcccttttatctcatagttcatctattgagtccctttctccagggggtgatttatttggattgggcatctttaaaaatggcagtgacagcctccagcgaagcacttctttagaaagttggttgacttcctataaaagcaatgaagatctctttagctgtcacagctctggggatataagcgtgagcagtggctcagttggtgaactaagtaaaagaacattagatctcctgaatcgtttggagaatatccagagcccctcagagcaaaagataaaacgaagtgtttctgatatcactcttcaaagcagttcccaaaagatgtcctttactggccagatgtcattggacatagcatcttctatcaatgaagactcagcggcatctctaacagaacttagcagcagtgacgagctctctctttgctcagaggatattgtgttacacaagaacaagatcccggaatcgaatgcatcgttcaggaagcgtctgactcgttcagtggctgatgaaagcgatgtcaatgtcagcatgattgttaatgtctcttgcacctctgcttgcactgatgatgaagatgacagcgacctgctctccagctctacccttaccttgactgaagaagagctgtgcatcaaagatgaggatgacgactccagtattgcaacagatgatgaaatttatgaagactgcaccttgatgtcagggctagactacataaagaatgaattacagacctggattaggccaaaattgtctttgacaagagataagaaaaggtgcaatgtcagtgatgagatgaagggcagtaaagatataagtagcagtgagatgaccaatccctctgatactctgaatattgagacccttctaaatggctctgtaaaacgtgtctctgaaaataatggaaatggtaagaattcatctcatacccatgagttagggacaaagcgtgaaaataagaaaactattttcaaagttaataaagatccatatgtggctgacatggaaaatggcaatattgaaggtattccagaaaggcaaaagggnaaaccgaatgtgacttcaaaggtatcagaaaatcttggttcacatgggaaagagatttcagagagtgagcattgtaagtgtaaagcacttatggatagtttagatgattcaaatactgctggcaaggaatttgtttcccaagatgttagacatcttccaaagaaatgtccaaatcaccaccattttgaaaatcaaagcactgcctctactcccactgagaagtctttctcagaactggctttagaaaccaggtttaacaacagacaagactctgatgcactgaaatcatctgatgatgcaccgagtatggctggaaaatctgctggttgttgcctagcacttgaacaaaacggaacagaggaaaatgcttctatcagcaacatttcctgttgcaactgtgagccagatgttttccatcaaaaagatgccgaagattgttcagtacacaactttgttaaggaaatcattgacatggcttcgacagccctaaaaagtaaatctcaacctgaaaacgaggtggctgctcctacttcattaactcaaatcaaggagaaagtgttggagcattctcaccggcccatccagctgagaaaaggggacttttattcgtacttatctctctcatctcatgacagtgattgtggggaggtcaccaattacatagaagagaaaagcagcactccattgccactagacaccactgactcgggcttagatgacaaggaagatattgaatgcttttttgaggcctgtgttgagggtgactctgatggagaggagccttgtttctctagtgctcctccaaatgaatctgcagttcccagcgaagctgcaatgccactacaagcaacagcatgttcttctgagttcagtgatagttctctttcagctgatgatgcagatacagtggctctttcaagtccttcctctcaggaaagagctgaggttggaaaggaagtgaatggtttgccccaaacttccagtggctgtgcagaaaacttagagtttactccttcaaagcttgacagtgaaaaggaaagttccggaaaaccaggtgaatctggaatgccagaagaacataatgctgcttcagccaaatctaaagttcaagacctctccttgaaggcaaatcagccaacagacaaggccgcattgcatcccagccccaaaactttaacctgtgaagaaaatcttctaaaccttcatgaaaaacgacatagaaatatgcataggtagaatgtaccccctccccaagcatgaaaatcatctcactgaaagatacgcctggctgcaactcaggggtggcctcatcctcccgccctgggctggcctctggttccatcacgtttgtcactgccgtttattacattgacttctcccaagatgaatcttccttccaaatgtgttttctccacacaagccttgtgatctgaatgtgtgcgctggttctctttaggtgatcgtctttgaagttcagcaaagctgcttgttctcccatggattcctgtcccaagctacctctaccaaccctctctctccagctagacttttctctttgcctcctcccttcccttccactctttaaagttctgcagttcaccaactggtagtccattaaattctcctgtctagaatgacccccccaccagtacttgaccaatttcatgtatcaatctggatttttttttaacggtataatgactgtgtttattgaaagagttttacctaaaaagccaacatttgaattggttgcagcatagagaagaaacactggtccttctttcaaaattaagcaactattaaaagcgccattttatttatttcatttaaaaaataatctatgcagcatttcaagaaacaaccatatggtgttgtatattataaactggtgacattctactattgaattatgtacaacattttcattttttatgcttcttgaggtggtaatgagaaaaaagttttttaaaaaagtgtgccttgctgtatttcttataccatttattaaaaagctgctttcacggtaaaattatgttggtttgaaaggaggaaatagcaaggttaagatgtgtgaataatttctgtatatatgtataaccaagtacaaacattgatgtataatgacagtataaaatgctttcatgtttgtgatgtctagtgatgtggaaaatataagccttaaatccattagattgcatggtaattaaaattggcataataaacacagattattgggggaaaaggaaaattagtgatctcttctactatgttctttaccaaattgttgcatctggttctgaaaaagtatagcatgtagcagcttccaaacatattcatattgcttaagaggcttaacattacctaaactagagactagacgtaaagccttcagttttcaaaatctttctggtcactataaagatcttggaacagcaaatgattaaatgtcagttcccctaaaccaataaacatttatactagattttttatttccacttatcattaatgatttaatgttggatttcaggtaccttgtatgtcttaatttattttaaatatttattttgaatgagtttgatagaaagctagtagaaaagtacagaaaatttgactattatttatagatttcaggtatatttatatgtgtaaaagaaattgacaaagaaatatttcatctggcctttactgactcctgttaaatgcagttttaaatttatatcgtaacacctacttaagtgcctgacacagtaggtattcaataaaaatttactgaattaaaggattaaattaggtgacatggtgacatctatccctttattttgacactaaaacatggacacaactagaaagaggtacaatgcaatataaagtcacaatagataatatatatcaaatttctaaaaggtaaagaatgttgtgggttcatgcagtcacaggaatgacaatcattcaacagatagttcagaaacactttttatctgcaaggcactattctagatccagaagatgcaatgttgaacaaacagacaaagccctgccctcagaaggctgtcctgcattaggaacaagtgaacacgcaaatgacatgaagtatttgttgcagagctgaggaacagagcaaatgtagtgatagaagcgcaatgagagaagcagcagtgggtacaaggaggaagaaaaagggcttgcagagagtggaaagttagtggaatattcatgaaacttcattgcaggggtaatagaagaaaaagtaaattgggaggacttaatggaaggtcttttaaaaagttaacttggagcttctgtatgtaaaatgctaggtaataaggacactttgtacaggctgttttgcacctgattttatttatcattagtgccacgccaagatcatttagacgatgcttatctgtaattctaccactttaataactatttgtatttttatgccccttctgatcttttccatatgtatttctaaatggataaattattctaggcttcttaataggtagtaatttgttcaaaagcggttttagccagacatctagttgcagtgttcaagaggattatgggggaaagagattagagataattgtctagttagggggcagctggagaaaataagctaagtttgcaataacagagtacacaagtatagtggcccaggatgtagtgaaagaacaaatcctagagtctttgaaatttctaagggcattctagacctctgttgggatatggtattattttacatactgacacaacctaaattttctttgggtagtaactaatgtcaagtctacatcgactggtaaaacattcaaagaacaaactgacaatgatgttctacctacttgttacatgctcatggaagaccgtgcagtattgaaagtatttgttaattatctgcttagtattaacactaaatttgtagaatgactttcaggtttgttgaacaatgccttttcaggttggaagaagaaaaatagcctcaatctcccaccccatgtaggcactacctccccaattacccttagaaaatgatcacaccaactctgcctacacacttccagtgatagtggctcattgtctgttaaggcaaactgttccactgttgggcatatctctttgttagaaagttctttcttaggttgctaaaatctgcctagtaccccgctaccctgttctgtcttatggagcagcccagattatctttactccctctttctcatggcaaccctgaagataatcaaggccagttactcatcatctcccaaccactgtttcctcaactgcccttcatatgtcatggttttcagatccattccaacctgactgaatgttaacagacagaattcttcacattaaggaactgtcttcatcatcatacatgtagaaaagaatctgaacatttaagtgcgaagttttctctagaaatatattcaagatatgtttattctattattgtaaatttcaaacaataaataaataagaatccatgacttccttcagtggcccagtccagtgcctaagtcatctggaatcttctccttacatcgaatacaaacctaacctgtttccaagtagggcactccctccgcttatttattcatttattcagccattcagcaaacatttattaaatggctacctatgtgaggcactatatttggcattaggtatataaaggcaactaacacatggtatctgtctccaaaggtttacagcttttcttctgaaagtgccttttgtgtccttgaatagagtgattatgacttttgtctcaattaaatgatgacctcatttagtttctgatgaagtttctctacatttaagaaaatctagtgagcaaaacggtatacaaaaaatcatctggatctgactaccagaaaaagtaaagtggttttaattacagaaagaaaaatatttgttagatttctggtcactgaataaatatgcatcttatacaac

SEQ ID NO: 442182 - DNA, 610 bp, Homo sapiens
gcagtctgggagctgagtgactgaggatttgaaaccttgctatagttacagttcataacaagtgtctaggcagttagaccttaagtgttcaggtatggaaagaaagtcatatgttatgttttagattctgtttgtaaagctggttaactagagacagctgatgaaaaaccaaatcgacttgagttacaagatctgggctttctctgctctgctttcaacctgttggttggtggtggagtagctgacagaagcgaatggcttggctgagggacatgaagtgacagcagcctgtttaggaccacaccacattttggacctcttgctgtgcagttcaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagaggtgagtgttttccttgaagttaa

SEQ ID NO: 442183 - DNA, 7925 bp, Homo sapiens
  misc_feature (2960)..(2960): n is a, c, g, or t
ccaacaaatagtgcagtaataatccagtatctaattttcgctttcagaacattattgctttgttaatcaagcttcggaagaggaatattgcttatctttttttttcagataatagattttatatataaaaatctttgcaatcttgtttaacttgttctcagccagtagaaaactgaactttttgcctccaaagaatgtaggagtaaatttggaaaaattctatttcttttcggaggatttttctatcttctgcgtttccttcgaccttatgtcaaagcatgtcaatctgtttggcattcatgtgacctaaatgatttatttcattaggctagaaattgttaattacccaggtgtctagggaggaccctacatttcggagggataaatcagtgaaaagtgtggaggaatgggatgcagctaaattctttagcatattggacttctgtaggaggcctccattctaaaagggacatcagagctcttcttgtcctattgttggtagctgagtgtatcactacaatttgaaattatgatggaagaaggtgtttcatgttttagggaactctgccctataaacactcatagattggtttctctctatgttgcagtccctctgtcgtgaaatcaagcaacgacgtcgaggagttgcctccattctgcgactatgccagcatcttttggatgaccgggagacttgcaatctgaatgcagaccaccagcccatgcagctgatcattgtaaatcttgaaagaaggtgggaagccattgtcatgcaagccgtccagtggcaaacacgtctacaaaagaagatgggaaaggaatctgagactttgaatgtgattgatcctggcttgatggacctaaatgggatgagtgaggatgccctggaatgggatgaaatggacataagtaacaagttaattagtttgaatgaggaatcaaatgaccttgatcaagaactccaacctgttatcccttccttgaagcttggagagacaagtaatgaggaccctggttatgacgaggaggctgataaccatgggggatctcagtatgcctcaaatattactgccccctctagtccacacatttaccaggtgtacagcctccacaatgttgaactctatgaggacaaccacatgccatttctgaaaaacaatccaaaggtcactggcatgacacagcctaatgttttaactaagagtctcagtaaagactcttcattttcatctaccaaatctttgccagatcttctaggtggttccaatttggtaaagccctgcgcatgtcatggaggagacatgagccagaattcaggcagtgagagtggaattgtcagtgaaggagacacagaaaccactaccaactctgaaatgtgcttgctcaatgcagtggatgggtccccaagtaaccttgaaactgaacatctggacccacaaatgggagatgcagttaacgtgttaaagcaaaaatttacagatgagggggaaagcattaagcttccaaatagctctcagtcgtccatttcaccagtgggttgtgtaaatggaaaagttggagatttaaacagtattaccaaacatacccctgactgtttgggagaagaattacaaggaaaacatgatgtgtttacattttatgattactcatacctccaaggctcaaaactcaaattaccaatgataatgaaacagtcacaaagcgaaaaagcgcatgtggaggatcccctgcttcgtggtttttattttgataaaaaatcatgcaaatctaaacatcagactacagagttacaaccagatgtacctccccatgaaaggattttggcaagtgcatctcatgaaatggatcgcatttcatataaaagtggcaatatagaaaagacattcactggcatgcagaatgccaaacagctctcccttttatctcatagttcatctattgagtccctttctccagggggtgatttatttggattgggcatctttaaaaatggcagtgacagcctccagcgaagcacttctttagaaagttggttgacttcctataaaagcaatgaagatctctttagctgtcacagctctggggatataagcgtgagcagtggctcagttggtgaactaagtaaaagaacattagatctcctgaatcgtttggagaatatccagagcccctcagagcaaaagataaaacgaagtgtttctgatatcactcttcaaagcagttcccaaaagatgtcctttactggccagatgtcattggacatagcatcttctatcaatgaagactcagcggcatctctaacagaacttagcagcagtgacgagctctctctttgctcagaggatattgtgttacacaagaacaagatcccggaatcgaatgcatcgttcaggaagcgtctgactcgttcagtggctgatgaaagcgatgtcaatgtcagcatgattgttaatgtctcttgcacctctgcttgcactgatgatgaagatgacagcgacctgctctccagctctacccttaccttgactgaagaagagctgtgcatcaaagatgaggatgacgactccagtattgcaacagatgatgaaatttatgaagactgcaccttgatgtcagggctagactacataaagaatgaattacagacctggattaggccaaaattgtctttgacaagagataagaaaaggtgcaatgtcagtgatgagatgaagggcagtaaagatataagtagcagtgagatgaccaatccctctgatactctgaatattgagacccttctaaatggctctgtaaaacgtgtctctgaaaataatggaaatggtaagaattcatctcatacccatgagttagggacaaagcgtgaaaataagaaaactattttcaaagttaataaagatccatatgtggctgacatggaaaatggcaatattgaaggtattccagaaaggcaaaagggnaaaccgaatgtgacttcaaaggtatcagaaaatcttggttcacatgggaaagagatttcagagagtgagcattgtaagtgtaaagcacttatggatagtttagatgattcaaatactgctggcaaggaatttgtttcccaagatgttagacatcttccaaagaaatgtccaaatcaccaccattttgaaaatcaaagcactgcctctactcccactgagaagtctttctcagaactggctttagaaaccaggtttaacaacagacaagactctgatgcactgaaatcatctgatgatgcaccgagtatggctggaaaatctgctggttgttgcctagcacttgaacaaaacggaacagaggaaaatgcttctatcagcaacatttcctgttgcaactgtgagccagatgttttccatcaaaaagatgccgaagattgttcagtacacaactttgttaaggaaatcattgacatggcttcgacagccctaaaaagtaaatctcaacctgaaaacgaggtggctgctcctacttcattaactcaaatcaaggagaaagtgttggagcattctcaccggcccatccagctgagaaaaggggacttttattcgtacttatctctctcatctcatgacagtgattgtggggaggtcaccaattacatagaagagaaaagcagcactccattgccactagacaccactgactcgggcttagatgacaaggaagatattgaatgcttttttgaggcctgtgttgagggtgactctgatggagaggagccttgtttctctagtgctcctccaaatgaatctgcagttcccagcgaagctgcaatgccactacaagcaacagcatgttcttctgagttcagtgatagttctctttcagctgatgatgcagatacagtggctctttcaagtccttcctctcaggaaagagctgaggttggaaaggaagtgaatggtttgccccaaacttccagtggctgtgcagaaaacttagagtttactccttcaaagcttgacagtgaaaaggaaagttccggaaaaccaggtgaatctggaatgccagaagaacataatgctgcttcagccaaatctaaagttcaagacctctccttgaaggcaaatcagccaacagacaaggccgcattgcatcccagccccaaaactttaacctgtgaagaaaatcttctaaaccttcatgaaaaacgacatagaaatatgcataggtagaatgtaccccctccccaagcatgaaaatcatctcactgaaagatacgcctggctgcaactcaggggtggcctcatcctcccgccctgggctggcctctggttccatcacgtttgtcactgccgtttattacattgacttctcccaagatgaatcttccttccaaatgtgttttctccacacaagccttgtgatctgaatgtgtgcgctggttctctttaggtgatcgtctttgaagttcagcaaagctgcttgttctcccatggattcctgtcccaagctacctctaccaaccctctctctccagctagacttttctctttgcctcctcccttcccttccactctttaaagttctgcagttcaccaactggtagtccattaaattctcctgtctagaatgacccccccaccagtacttgaccaatttcatgtatcaatctggatttttttttaacggtataatgactgtgtttattgaaagagttttacctaaaaagccaacatttgaattggttgcagcatagagaagaaacactggtccttctttcaaaattaagcaactattaaaagcgccattttatttatttcatttaaaaaataatctatgcagcatttcaagaaacaaccatatggtgttgtatattataaactggtgacattctactattgaattatgtacaacattttcattttttatgcttcttgaggtggtaatgagaaaaaagttttttaaaaaagtgtgccttgctgtatttcttataccatttattaaaaagctgctttcacggtaaaattatgttggtttgaaaggaggaaatagcaaggttaagatgtgtgaataatttctgtatatatgtataaccaagtacaaacattgatgtataatgacagtataaaatgctttcatgtttgtgatgtctagtgatgtggaaaatataagccttaaatccattagattgcatggtaattaaaattggcataataaacacagattattgggggaaaaggaaaattagtgatctcttctactatgttctttaccaaattgttgcatctggttctgaaaaagtatagcatgtagcagcttccaaacatattcatattgcttaagaggcttaacattacctaaactagagactagacgtaaagccttcagttttcaaaatctttctggtcactataaagatcttggaacagcaaatgattaaatgtcagttcccctaaaccaataaacatttatactagattttttatttccacttatcattaatgatttaatgttggatttcaggtaccttgtatgtcttaatttattttaaatatttattttgaatgagtttgatagaaagctagtagaaaagtacagaaaatttgactattatttatagatttcaggtatatttatatgtgtaaaagaaattgacaaagaaatatttcatctggcctttactgactcctgttaaatgcagttttaaatttatatcgtaacacctacttaagtgcctgacacagtaggtattcaataaaaatttactgaattaaaggattaaattaggtgacatggtgacatctatccctttattttgacactaaaacatggacacaactagaaagaggtacaatgcaatataaagtcacaatagataatatatatcaaatttctaaaaggtaaagaatgttgtgggttcatgcagtcacaggaatgacaatcattcaacagatagttcagaaacactttttatctgcaaggcactattctagatccagaagatgcaatgttgaacaaacagacaaagccctgccctcagaaggctgtcctgcattaggaacaagtgaacacgcaaatgacatgaagtatttgttgcagagctgaggaacagagcaaatgtagtgatagaagcgcaatgagagaagcagcagtgggtacaaggaggaagaaaaagggcttgcagagagtggaaagttagtggaatattcatgaaacttcattgcaggggtaatagaagaaaaagtaaattgggaggacttaatggaaggtcttttaaaaagttaacttggagcttctgtatgtaaaatgctaggtaataaggacactttgtacaggctgttttgcacctgattttatttatcattagtgccacgccaagatcatttagacgatgcttatctgtaattctaccactttaataactatttgtatttttatgccccttctgatcttttccatatgtatttctaaatggataaattattctaggcttcttaataggtagtaatttgttcaaaagcggttttagccagacatctagttgcagtgttcaagaggattatgggggaaagagattagagataattgtctagttagggggcagctggagaaaataagctaagtttgcaataacagagtacacaagtatagtggcccaggatgtagtgaaagaacaaatcctagagtctttgaaatttctaagggcattctagacctctgttgggatatggtattattttacatactgacacaacctaaattttctttgggtagtaactaatgtcaagtctacatcgactggtaaaacattcaaagaacaaactgacaatgatgttctacctacttgttacatgctcatggaagaccgtgcagtattgaaagtatttgttaattatctgcttagtattaacactaaatttgtagaatgactttcaggtttgttgaacaatgccttttcaggttggaagaagaaaaatagcctcaatctcccaccccatgtaggcactacctccccaattacccttagaaaatgatcacaccaactctgcctacacacttccagtgatagtggctcattgtctgttaaggcaaactgttccactgttgggcatatctctttgttagaaagttctttcttaggttgctaaaatctgcctagtaccccgctaccctgttctgtcttatggagcagcccagattatctttactccctctttctcatggcaaccctgaagataatcaaggccagttactcatcatctcccaaccactgtttcctcaactgcccttcatatgtcatggttttcagatccattccaacctgactgaatgttaacagacagaattcttcacattaaggaactgtcttcatcatcatacatgtagaaaagaatctgaacatttaagtgcgaagttttctctagaaatatattcaagatatgtttattctattattgtaaatttcaaacaataaataaataagaatccatgacttccttcagtggcccagtccagtgcctaagtcatctggaatcttctccttacatcgaatacaaacctaacctgtttccaagtagggcactccctccgcttatttattcatttattcagccattcagcaaacatttattaaatggctacctatgtgaggcactatatttggcattaggtatataaaggcaactaacacatggtatctgtctccaaaggtttacagcttttcttctgaaagtgccttttgtgtccttgaatagagtgattatgacttttgtctcaattaaatgatgacctcatttagtttctgatgaagtttctctacatttaagaaaatctagtgagcaaaacggtatacaaaaaatcatctggatctgactaccagaaaaagtaaagtggttttaattacagaaagaaaaatatttgttagatttctggtcactgaataaatatgcatcttatacaac

SEQ ID NO: 442184 - DNA, 3822 bp, Homo sapiens
catcatgcagcaggtcaaacaaggcatctcctagtattgcatcctacagatgtgctgtaaacatcaaaagaagacggtgggatcaggagatgctgttttggaaagaagtgaggtttagacttctccatgttaaccatgagcgtgacactttcccccctgaggtcacaggacctggatcccatggctactgatgcttcacccatggccatcaacatgacacccactgtggagcagggtgagggagaagaggcaatgaaggacatggactctgaccagcagtatgaaaagccacccccactacacacaggggctgactggaagattgtcctccacttacctgaaattgagacctggctccggatgacctcagagagggtccgagacctaacctattcagtccagcaggattcggacagcaagcatgtggatgtacatctagttcaactaaaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagcttatccgaagtgttggtttacttacggtagctgctgactctatctctaccaatggcagtgaagcagttactgaggaggtatctcaagtatctctctcagtagacgacaaaggtggatgtgaggaagacaatgcttctgcagtcgaagagcaaccaggcttaacactgggggtgtcatcatcttcaggagaagctctgacaaatgctgctcaaccctcctctgagactgtgcagcaagaatccagttcctcctcccatcatgatgcaaagaatcagcagcctgttccttgtgaaaatgcaacccccaaacgaaccatcagagattgctttaattataacgaggactctcccacgcagcctacattgccaaaaagaggactttttcttaaagaggaaacttttaagaatgatctgaaaggcaatggtggaaagaggcaaatggttgatctaaagcctgagatgagcagaagcaccccttcgctagtagatcctcctgacagatccaaactttgcctggtattgcagtcttcttaccccaacagcccttctgctgccagccagtcttatgagtgtttacacaaggtggggaatgggaaccttgaaaacacagtcaaatttcacattaaagaaatttcttccagcctgggaaggcttaacgactgctataaagagaaatctcgacttaaaaagccacacaagacctcagaagaggtgcctccatgccgaacacctaaacgggggactggttcaggcaaacaagctaaaaatacaaagagctcagcagtgccaaatggagagctttcttatacttccaaggccatagaggggccacaaacaaattctgcttccacatcctcacttgagccttgtaatcagagaagttggaatgccaaattgcaattgcagtcagaaacatccagttcaccagcttttactcagagcagtgaatcctctgttggctcagacaacatcatgtctccggtgccacttctttcaaaacacaaaagcaaaaaaggtcaagcctcctctccaagtcacgtcactaggaatggtgaggttgtggaggcctggtatggctctgatgaatacctagcactgccctctcaccttaagcagacagaagtattggctttgaagttggaaaacctaacaaagcttctgcctcagaaacccagaggagaaaccatccagaatattgatgactgggaactgtctgaaatgaattcagattctgaaatctatccaacctatcatgtcaaaaagaagcatacaaggctaggcagggtgtctccaagctcatctagtgacatagcctcttcactaggggagagcattgaatctgggcccctgagtgacattctttctgatgaggagtccagtatgcctctcgctggcatgaaaaagtatgctgatgagaagtcagaaagagcttcatcctctgagaaaaatgagagccattctgccactaaatcagctttaattcagaaactgatgcaagatattcagcaccaagacaactatgaagccatatgggaaaaaatagaggggtttgtaaacaaactggatgaattcattcaatggttaaatgaagccatggaaactacagagaattggactccccctaaagcagagatggatgaccttaaactgtatctggagacacacttgagttttaagttgaatgtagacagtcattgtgctctcaaggaagctgtggaggaggaaggacaccaacttcttgagcttattgcatctcacaaagcaggactgaaggacatgctgcggatgattgcaagtcaatggaaggagctgcagaggcaaatcaaacggcagcacagctggattctcagggctctggataccatcaaagccgagatactggctactgatgtgtctgtggaggatgaggaagggactggaagccccaaggctgaggttcaactatgctacctggaagcacaaagagatgctgttgagcagatgtccctcaagctgtacagcgagcagtataccagcagcagcaagcgaaaggaagagtttgctgatatgtcaaaagttcattcagtgggaagcaatgggcttctggactttgattcagaatatcaggagctctgggattggctgattgacatggagtcccttgtgatggacagccacgacctgatgatgtcagaggagcagcagcagcatctttacaagcgatacagtgtggaaatgtccatcagacacctgaaaaagacggagctgcttagtaaggttgaagctttgaagaaaggtggcgttttactaccaaatgatctccttgaaaaagtggattcaattaatgaaaaatgggaactgcttgggaaaaccctaggagagaagatccaggacacaatggcagggcacagtgggtcgagtccacgtgacctgctctctcctgaaagtggaagcctggtaaggcagctggaggtcaggatcaaagaactgaaaggatggctaagagatacagagcttttcatcttcaattcctgtctgagacaagaaaaggaaggaacaatgaatactgagaaacaactgcaatactttaagtccctctgtcgtgaaatcaagcaacgacgtcgaggagttgcctccattctgcgactatgccagcatcttttggatgaccgggagacttgcaatctgaatgcagaccaccagcccatgcagctgatcattgtaaatcttgaaagaaggtgggaagccattgtcatgcaagccgtccagtggcaaacacgtctacaaaagaagatgggaaaggaatctgtgagtgatgctttttttaagcataattgtctgtcattttctcagacaaaaaataattctttcaggcttggaaacggtgttcatcttataaatggttttactaactaa

SEQ ID NO: 442185 - DNA, 327 bp, Homo sapiens
  misc_feature (308)..(308): n is a, c, g, or t
ccatagtggcaacgtggtcgactcagccaacagacaaggccgcattgcatcccgccctgggctggcctctggttccatcacgttgtcactgccgtttattacattgacttctcccaagcatgaaaatcatctcactgaaagatacgcctggctgcaactcaggggtggcctcatcctcccgccctgggctggcctctggttccatcacgtttgtcactgccgtttattacattgacttctcccaagatgaaaatcatctcactgaaagatacgcctggctgcaactcaggggtggcctcatcctcccngaccacgtctgccacatgg

SEQ ID NO: 442186 - DNA, 7314 bp, Homo sapiens
  misc_feature (5850)..(5850): n is a, c, g, or t
  misc_feature (7295)..(7295): n is a, c, g, or t
catcatgcagcaggtcaaacaaggcatctcctagtattgcatcctacagatgtgctgtaaacatcaaaagaagacggtgggatcaggagatgctgttttggaaagaagtgaggtttagacttctccatgttaaccatgagcgtgacactttcccccctgaggtcacaggacctggatcccatggctactgatgcttcacccatggccatcaacatgacacccactgtggagcagggtgagggagaagaggcaatgaaggacatggactctgaccagcagtatgaaaagccacccccactacacacaggggctgactggaagattgtcctccacttacctgaaattgagacctggctccggatgacctcagagagggtccgagacctaacctattcagtccagcaggattcggacagcaagcatgtggatgtacatctagttcaactaaaggacatttgtgaagatatttctgatcatgttgagcaaatccatgccctccttgaaacagagttctccctaaagctgctgtcttactctgtcaacgtgatagtggacatccacgcagtgcagctcctctggcaccagcttcgagtctcagtgctggttctgcgggagcgcattctgcaaggtctgcaggacgccaatggcaactacactaggcagacggacattctgcaagctttctctgaagagacaaaagagggccggcttgattctctaacagaagtggatgactcaggacaattaaccatcaaatgttctcaaaattacttgtctctggattgtggcattactgcattcgaactgtctgactacagtccaagtgaggatttgctcagtgggctaggtgacatgacctctagccaagtcaaaaccaaaccctttgactcttggagctacagtgagatggaaaaggagtttcctgagcttatccgaagtgttggtttacttacggtagctgctgactctatctctaccaatggcagtgaagcagttactgaggaggtatctcaagtatctctctcagtagacgacaaaggtggatgtgaggaagacaatgcttctgcagtcgaagagcaaccaggcttaacactgggggtgtcatcatcttcaggagaagctctgacaaatgctgctcaaccctcctctgagactgtgcagcaagaatccagttcctcctcccatcatgatgcaaagaatcagcagcctgttccttgtgaaaatgcaacccccaaacgaaccatcagagattgctttaattataacgaggactctcccacgcagcctacattgccaaaaagaggactttttcttaaagaggaaacttttaagaatgatctgaaaggcaatggtggaaagaggcaaatggttgatctaaagcctgagatgagcagaagcaccccttcgctagtagatcctcctgacagatccaaactttgcctggtattgcagtcttcttaccccaacagcccttctgctgccagccagtcttatgagtgtttacacaaggtggggaatgggaaccttgaaaacacagtcaaatttcacattaaagaaatttcttccagcctgggaaggcttaacgactgctataaagagaaatctcgacttaaaaagccacacaagacctcagaagaggtgcctccatgccgaacacctaaacgggggactggttcaggcaaacaagctaaaaatacaaagagctcagcagtgccaaatggagagctttcttatacttccaaggccatagaggggccacaaacaaattctgcttccacatcctcacttgagccttgtaatcagagaagttggaatgccaaattgcaattgcagtcagaaacatccagttcaccagcttttactcagagcagtgaatcctctgttggctcagacaacatcatgtctccggtgccacttctttcaaaacacaaaagcaaaaaaggtcaagcctcctctccaagtcacgtcactaggaatggtgaggttgtggaggcctggtatggctctgatgaatacctagcactgccctctcaccttaagcagacagaagtattggctttgaagttggaaaacctaacaaagcttctgcctcagaaacccagaggagaaaccatccagaatattgatgactgggaactgtctgaaatgaattcagattctgaaatctatccaacctatcatgtcaaaaagaagcatacaaggctaggcagggtgtctccaagctcatctagtgacatagcctcttcactaggggagagcattgaatctgggcccctgagtgacattctttctgatgaggagtccagtatgcctctcgctggcatgaaaaagtatgctgatgagaagtcagaaagagcttcatcctctgagaaaaatgagagccattctgccactaaatcagctttaattcagaaactgatgcaagatattcagcaccaagacaactatgaagccatatgggaaaaaatagaggggtttgtaaacaaactggatgaattcattcaatggttaaatgaagccatggaaactacagagaattggactccccctaaagcagagatggatgaccttaaactgtatctggagacacacttgagttttaagttgaatgtagacagtcattgtgctctcaaggaagctgtggaggaggaaggacaccaacttcttgagcttattgcatctcacaaagcaggactgaaggacatgctgcggatgattgcaagtcaatggaaggagctgcagaggcaaatcaaacggcagcacagctggattctcagggctctggataccatcaaagccgagatactggctactgatgtgtctgtggaggatgaggaagggactggaagccccaaggctgaggttcaactatgctacctggaagcacaaagagatgctgttgagcagatgtccctcaagctgtacagcgagcagtataccagcagcagcaagcgaaaggaagagtttgctgatatgtcaaaagttcattcagtgggaagcaatgggcttctggactttgattcagaatatcaggagctctgggattggctgattgacatggagtcccttgtgatggacagccacgacctgatgatgtcagaggagcagcagcagcatctttacaagcgatacagtgtggaaatgtccatcagacacctgaaaaagacggagctgcttagtaaggttgaagctttgaagaaaggtggcgttttactaccaaatgatctccttgaaaaagtggattcaattaatgaaaaatgggaactgcttgggaaaaccctaggagagaagatccaggacacaatggcagggcacagtgggtcgagtccacgtgacctgctctctcctgaaagtggaagcctggtaaggcagctggaggtcaggatcaaagaactgaaaggatggctaagagatacagagcttttcatcttcaattcctgtctgagacaagaaaaggaaggaacaatgaatactgagaaacaactgcaatactttaagtccctctgtcgtgaaatcaagcaacgacgtcgaggagttgcctccattctgcgactatgccagcatcttttggatgaccgggagacttgcaatctgaatgcagaccaccagcccatgcagctgatcattgtaaatcttgaaagaaggtgggaagccattgtcatgcaagccgtccagtggcaaacacgtctacaaaagaagatgggaaaggaatctgagactttgaatgtgattgatcctggcttgatggacctaaatgggatgagtgaggatgccctggaatgggatgaaatggacataagtaacaagttaattagtttgaatgaggaatcaaatgaccttgatcaagaactccaacctgttatcccttccttgaagcttggagagacaagtaatgaggaccctggttatgacgaggaggctgataaccatgggggatctcagtatgcctcaaatattactgccccctctagtccacacatttaccaggtgtacagcctccacaatgttgaactctatgaggacaaccacatgccatttctgaaaaacaatccaaaggtcactggcatgacacagcctaatgttttaactaagagtctcagtaaagactcttcattttcatctaccaaatctttgccagatcttctaggtggttccaatttggtaaagccctgcgcatgtcatggaggagacatgagccagaattcaggcagtgagagtggaattgtcagtgaaggagacacagaaaccactaccaactctgaaatgtgcttgctcaatgcagtggatgggtccccaagtaaccttgaaactgaacatctggacccacaaatgggagatgcagttaacgtgttaaagcaaaaatttacagatgagggggaaagcattaagcttccaaatagctctcagtcgtccatttcaccagtgggttgtgtaaatggaaaagttggagatttaaacagtattaccaaacatacccctgactgtttgggagaagaattacaaggaaaacatgatgtgtttacattttatgattactcatacctccaaggctcaaaactcaaattaccaatgataatgaaacagtcacaaagcgaaaaagcgcatgtggaggatcccctgcttcgtggtttttattttgataaaaaatcatgcaaatctaaacatcagactacagagttacaaccagatgtacctccccatgaaaggattttggcaagtgcatctcatgaaatggatcgcatttcatataaaagtggcaatatagaaaagacattcactggcatgcagaatgccaaacagctctcccttttatctcatagttcatctattgagtccctttctccagggggtgatttatttggattgggcatctttaaaaatggcagtgacagcctccagcgaagcacttctttagaaagttggttgacttcctataaaagcaatgaagatctctttagctgtcacagctctggggatataagcgtgagcagtggctcagttggtgaactaagtaaaagaacattagatctcctgaatcgtttggagaatatccagagcccctcagagcaaaagataaaacgaagtgtttctgatatcactcttcaaagcagttcccaaaagatgtcctttactggccagatgtcattggacatagcatcttctatcaatgaagactcagcggcatctctaacagaacttagcagcagtgacgagctctctctttgctcagaggatattgtgttacacaagaacaagatcccggaatcgaatgcatcgttcaggaagcgtctgactcgttcagtggctgatgaaagcgatgtcaatgtcagcatgattgttaatgtctcttgcacctctgcttgcactgatgatgaagatgacagcgacctgctctccagctctacccttaccttgactgaagaagagctgtgcatcaaagatgaggatgacgactccagtattgcaacagatgatgaaatttatgaagactgcaccttgatgtcagggctagactacataaagaatgaattacagacctggattaggccaaaattgtctttgacaagagataagaaaaggtgcaatgtcagtgatgagatgaagggcagtaaagatataagtagcagtgagatgaccaatccctctgatactctgaatattgagacccttctaaatggctctgtaaaacgtgtctctgaaaataatggaaatggtaagaattcatctcatacccatgagttagggacaaagcgtgaaaataagaaaactattttcaaagttaataaagatccatatgtggctgacatggaaaatggcaatattgaaggtattccagaaaggcaaaagggnaaaccgaatgtgacttcaaaggtatcagaaaatcttggttcacatgggaaagagatttcagagagtgagcattgtaagtgtaaagcacttatggatagtttagatgattcaaatactgctggcaaggaatttgtttcccaagatgttagacatcttccaaagaaatgtccaaatcaccaccattttgaaaatcaaagcactgcctctactcccactgagaagtctttctcagaactggctttagaaaccaggtttaacaacagacaagactctgatgcactgaaatcatctgatgatgcaccgagtatggctggaaaatctgctggttgttgcctagcacttgaacaaaacggaacagaggaaaatgcttctatcagcaacatttcctgttgcaactgtgagccagatgttttccatcaaaaagatgccgaagattgttcagtacacaactttgttaaggaaatcattgacatggcttcgacagccctaaaaagtaaatctcaacctgaaaacgaggtggctgctcctacttcattaactcaaatcaaggagaaagtgttggagcattctcaccggcccatccagctgagaaaaggggacttttattcgtacttatctctctcatctcatgacagtgattgtggggaggtcaccaattacatagaagagaaaagcagcactccattgccactagacaccactgactcgggcttagatgacaaggaagatattgaatgcttttttgaggcctgtgttgagggtgactctgatggagaggagccttgtttctctagtgctcctccaaatgaatctgcagttcccagcgaagctgcaatgccactacaagcaacagcatgttcttctgagttcagtgatagttctctttcagctgatgatgcagatacagtggctctttcaagtccttcctctcaggaaagagctgaggttggaaaggaagtgaatggtttgccccaaacttccagtggctgtgcagaaaacttagagtttactccttcaaagcttgacagtgaaaaggaaagttccggaaaaccaggtgaatctggaatgccagaagaacataatgctgcttcagccaaatctaaagttcaagacctctccttgaaggcaaatcagccaacagacaaggccgcattgcatcccagccccaaaactttaacctgtgaagaaaatcttctaaaccttcatgaaaaacgacatagaaatatgcataggtagaatgtaccccctccccaagcatgaaaatcatctcactgaaagatacgcctggctgcaactcaggggtggcctcatcctcccgccctgggctggcctctggttccatcacgtttgtcactgccgtttattacattgacttctcccaagatgaaaatcatctcactgaaagatacgcctggctgcaactcaggggtggcctcatcctcccngaccacgtctgccacatgg

SEQ ID NO: 442187 - DNA, 269 bp, Homo sapiens
aaaggaaagttccggaaaaccaggtgaatctggaatgccagaagaacataatgctgcttcagccaaatctaaagttcaagacctctccttgaaggcaaatcagccaacagacaaggccgcattgcatcccagccccaaaactttaacctgtgaagaaaatcttctaaaccttcatgaaaaacgacatagaaatatgcataggtagaatgtaccccctccccaagcatgaaaatcatctcactgaaaggtacgtatagtcctcatgccgt

SEQ ID NO: 442188 - DNA, 4495 bp, Homo sapiens
ccagggactctgcctctaaggatgatgtctgccttggcctgccatgcctggaattccaattcatctttactggttctaaaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442189 - DNA, 4739 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442190 - DNA, 499 bp, Homo sapiens
  misc_feature (6)..(6): n is a, c, g, or t
caaatngatttcctcttcaaagaattggacgatgaaaggaattagagagctaggatggcggtttagagaaggtaaagaacagacttaagcatgtttgcagaaggaaaagacaaagtgcaaagaattcaaagaagctgaagatggcattgggggtaggaggtgggtagcaggagcagggtttgataaagacagaagaggtatgatcccataaaaagataacatgatgaacttggaagtaactaaggtcatctctttctttgtggcaaaatccaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagtatgtttccaaataccttat

SEQ ID NO: 442191 - DNA, 683 bp, Homo sapiens
caatttagtggaatttcttaacttttctcataccagagggcaacacctgtaagtagagtccaagcattcttgctagagaagaaatttttgtacactgtagtgtgattgctaagacttgagcaaggataaaatgttactgaaatctaagggagtattgctagtaaatggatgtgtgttttctgtttttcaaagtttgtgttaaattgttaatttaacaagttgacattttcttgtacccctgagtttgtcaaaattaggtacatgaattgccacttctgtgttggtataacagtactaacagcattgcttagccacaaaacttgaggtgaacttgccgatatactgctaacatcttaactgtgttttattattggacttctgagataaggagggcatggtaatgcagcagcagcagcagcgctggagacattgaacccgtgtgaaaagagccaggacactggaggccagcagatagcagtgtcagtctttccttctagttttgccacttcgttttctgtgtatacttggctcagtttcctaacttacttgagctgtggtttccctatctatagaatgggaataaatacctcatggggttgttgtaacggtgagaatttgtgaactgccaagtacagtggttggcatatattaagtaataaatggtgattattggctttttaaat

SEQ ID NO: 442192 - DNA, 866 bp, Homo sapiens
  misc_feature (596)..(596): n is a, c, g, or t
  misc_feature (604)..(604): n is a, c, g, or t
  misc_feature (613)..(614): n is a, c, g, or t
  misc_feature (626)..(626): n is a, c, g, or t
  misc_feature (628)..(628): n is a, c, g, or t
  misc_feature (644)..(644): n is a, c, g, or t
  misc_feature (647)..(648): n is a, c, g, or t
  misc_feature (668)..(669): n is a, c, g, or t
  misc_feature (676)..(676): n is a, c, g, or t
  misc_feature (681)..(682): n is a, c, g, or t
  misc_feature (699)..(700): n is a, c, g, or t
  misc_feature (706)..(706): n is a, c, g, or t
  misc_feature (710)..(710): n is a, c, g, or t
  misc_feature (714)..(714): n is a, c, g, or t
  misc_feature (716)..(716): n is a, c, g, or t
gagatttctctttagcacaagcctgagcataccatattaggcataaaaacttatattagaaatcatttctgaaattcataggatgggcttgtatggtcaacagtaggtagactctttaatgtacttttcaaggtgctatctcttgatatttttattttgtaatagcaaatgttgataggtagggatctaagttgtattactgtttacctaaaatcttgctacatgtattcatgttctggtttagaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggtntagagacnagtgaaganntgatgaatggcncntgtgcaggtgaggtgnaanncaatcgtctgggaacgaggnnttccgangtcgnngagtgttgggcgagaannatgggngtgngggngnatcccagattttacgagtgggctcttctttcgaaagagctgggtgaacacataggttgcatctgggacaactgggggccaaggggggggcctgttcacggggggacccattaaagaggtggcgcgctcaaagagcaggccgcactttcgg

SEQ ID NO: 442193 - DNA, 4692 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442194 - DNA, 4807 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacagttcttttaagatagggcaggaatgaaaactctcaatatagagcaggattttaaacctggggcccgtgcatattcttcagggaatccagaaacctggagattatatgtaaaacttagttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442195 - DNA, 4519 bp, Homo sapiens
ctttggaaaaatccatggaccactctcgacaccggcgaagttatcccttcctgtccccgaggggtgtgtcctagcgattcggcctgaccccttcagtttccaaaagttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442196 - DNA, 4234 bp, Homo sapiens
agaggatcccgaagccattgctacatatggctagccagttttcccagcaccatttattaaatagggaatcctttccccatggctggtttttctcaggttggtcaaagatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442197 - DNA, 4478 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442198 - DNA, 4594 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttgattattattcaaaaaaaaaagttctaa

SEQ ID NO: 442199 - DNA, 5072 bp, Homo sapiens
  misc_feature (4710)..(4710): n is a, c, g, or t
  misc_feature (4834)..(4834): n is a, c, g, or t
  misc_feature (4865)..(4865): n is a, c, g, or t
  misc_feature (4883)..(4883): n is a, c, g, or t
  misc_feature (4915)..(4915): n is a, c, g, or t
  misc_feature (4927)..(4927): n is a, c, g, or t
  misc_feature (4935)..(4935): n is a, c, g, or t
  misc_feature (4937)..(4937): n is a, c, g, or t
  misc_feature (4942)..(4942): n is a, c, g, or t
  misc_feature (4995)..(4995): n is a, c, g, or t
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttgaaatgccctcctcgcctcacggtggagtctgccgcgctccctctaaggaggctattcatgatctccgtcactgcatcctgccctcgtcggtcgttgcgctgacggtatatttactcaagccgccattgtcctcacacatccgncatactctagaagacctccgcccacgctataacggcgccacctcaccgccggtcctccgttttctatatgttcgcctccgcaggcaccagaatgacccaagcgcggatgccacaccctgcttcnataccctgcgttccttgtacctccctccgcnttcttccactcgcgcccncgacctgctccttccccttgcgcgcgggtcantgtatatccgtntatacacncnttcgngtgcacctcgcgcgcgacatctatctacacctactatctctatatgtcacgtnatccccctccttgatatataccaccgaccgccaccgctcgcgttagtcgcgcgcacactgtgtgtgtatcttcgccc

SEQ ID NO: 442200 - DNA, 2459 bp, Homo sapiens
  misc_feature (132)..(132): n is a, c, g, or t
actgatggacattttggtcataaggtgctgttggggtgcaacactgaataaggatgccaccaaagcagctacagcagctgcagatttcacagccaaagtgtgggatgctgtctcaggagatgagttgatgancctggctcataaacacattgtcaagactgtggatttcacgcaggatagtaattatttgttaaccgggggacaggataaactgttacgcatatatgacttgaaccaacctgaagcagaacctaaggaagttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442201 - DNA, 2194 bp, Homo sapiens
cggacgcgtgggtcgacccacgcgtccggctacagactcttgtttctgaacagcctaataaggatgttgtggacaaatggaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442202 - DNA, 1346 bp, Homo sapiens
  misc_feature (18)..(18): n is a, c, g, or t
  misc_feature (36)..(37): n is a, c, g, or t
  misc_feature (39)..(39): n is a, c, g, or t
gggggggccgccctgganagaggattggtttttttnngncccttcgggtaaagaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442203 - DNA, 1346 bp, Homo sapiens
acgacgaccacgcaacgctttgtgccgttaatactcacaaacacctagcaaagaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442204 - DNA, 1361 bp, Homo sapiens
  misc_feature (19)..(19): n is a, c, g, or t
cttattttccttctttatngaccaacaggcatcttcttttccccctcatgaagaattattaaaagtaatttcagaaagagagaaagaaataagtggtctctggaatgagttagattctttgaaggatgcagttgaacaccagaggaagaaaaacaatagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442205 - DNA, 4235 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagacacgatggttggtgatgcagcagccatcttgtgaccaagaagaaaggccaaaagaattgcaggagaattggccctaaaatcaatgaaactctcacccacccctttaacctcttgtctccagacttctgggtatgtaaaaacacaacacaaca

SEQ ID NO: 442206 - DNA, 1223 bp, Homo sapiens
tcctgggagcaaaacaatgaaccaacagcccccaagcagggaactagatgatgaactcaaccaatttacaatagctgcaaaaaagttaaaatccttagtaatatatttaacaaaggagtccaaagaccgctacatgtaaaactacaaaacactgctgaaaaaaatcacagacaatgcaaacaaatggaaacacatcccatgctcatggatgggtagaaccagtattgtgaaaatgaccataccactgaaagcaatctacaaattcaatgcaatcctcatcggaatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442207 - DNA, 874 bp, Homo sapiens
  misc_feature (5)..(5): n is a, c, g, or t
  misc_feature (84)..(84): n is a, c, g, or t
ggatntggaaatttgggaggggaggagaacattgggaatggaattggaaaggcagagtggaacgatcaacttatttaacagaantcagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442208 - DNA, 3393 bp, Homo sapiens
  misc_feature (3298)..(3298): n is a, c, g, or t
  misc_feature (3312)..(3312): n is a, c, g, or t
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaattgaaaggcaacaaacaaggtgggnaagcctgtttgaantttgggagggcttaaaaggaaagtttcctcaaaaaaaaatttaattttccaaaaagggtggtcccgggtcccctttccaaa

SEQ ID NO: 442209 - DNA, 3906 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgcgccgaccggcacctgcctggacgaggttagaacgcggctaaagagaggggcagggactttcagcaaaccaggcggtacggtggcccatgaaacactgtgtggccatgggcgggtaaacaaattcacagggccgtttcctccagagtaaaatgtaccgtctagagagaacggccgcgtgaaacccgggacgacgcgaaaacaccggcgcgcgcggtacccacggacctcgttgattacatgatggagtcgatgttttttctctactcttggtgtcattatagtgcgcacagcacaggagcacaaacaccacaccacacatacgacgccgacaacgacccaacctcgcgacaccatagaagcagaggcgaccaatcagacggcaggacctcacaccagcgggcggcgcaaggcggaaaaacgacgccagtcgcacagcgcagggagagcgagacgaagacgacgaacactcgacacagacctcaccaagcaacacagcgcagggcccagcgaaagccgagcgcaccaagccgccgacgacacgccgacccccgagcgcgaaggaagcgcagagcacgacccgggcgatgcggcagaccgagacgaccgcacacgaaggcaccggagacggacaggaggagagcgagggcacacagacgagaggcacggaggcagagggaacacaaagagcactcggaccgagacgggcgggagagagagacacaacggagaacagaaggcgaaagagcacgagagacagagcagacgcgacggcagagagggcaacagaagacagagccgacagccacaggcaaaacgacagagagaccgaggcagcgcgcacggaggaggccacagagagagcgacgcagccgagcagcgagaagagaccgacggtgagaggagcgacggaagacgg

SEQ ID NO: 442210 - DNA, 2602 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagctataaggatgttgtggaacaatggtgcgttcagaaacgatgagaagtcgacggggacgattctgaacggactatcagggggatacagaaggcgaatcataaaccaatccctcgtcaaatcgattaagcaccagcgggttgccccattggacaacaggtccacaggataccgtcagccgcacaccaatagaggcaacgaccgcaaatcatgagatcgcgcaaacgaggaacaccgagggacattag

SEQ ID NO: 442211 - DNA, 2022 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcaaagaccccaaaaggggtaacgagctcgagttc

SEQ ID NO: 442212 - DNA, 2060 bp, Homo sapiens
  misc_feature (2058)..(2058): n is a, c, g, or t
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagtacctcctgcttcatgttctagctagaaggaattacgataaagtgcattgcacaataaaccatgtgttagaaattagaacgtggtaccngc

SEQ ID NO: 442213 - DNA, 2117 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggaacaaaatagcacataagtagacctacataaaagtaatcaactgatttttatgaaggagcaaaggtaatacaatggagaaaatataatatttccaacaaatagtattaaaacaactggacacctatgtgcaaaaaaaaatcataacacggatctatgccattcacaaaaaataactccaaatggatcataaacctaaatgtaagatg

SEQ ID NO: 442214 - DNA, 1109 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagctgtccacccatcccctgccccaaaaccaggtttcaataaatttacgttcatttccaaaaaaaaaaaaaaaaaaaaaaaaaaaaaaaaaaaaaaaaaaagaaaaaaaaaaaaaaaaaaaaaaaaaaaaaaaaacaaaaaaaaaaaaaaaaaaaaaaaagaaagaggggggggggggggaggaaagaaccccgggggggggggaagagcaacggaggacaccgcagcggctagcggaaggccaacgcgacggaccgacaccacagcagagggggacacaccacacagacaggccaaacaagggcgagggcggtaggctaaaaaagagcgcgaccgaggagggacaaacaaaagagatgcagaaggccaacaaggagagaaaacaacaatcaacaggcggagggggacaaaaaacgcaaaaaaccacacccaaagaagacgagccgaagcaggagaaaaaaacacaagcgagaagacaggggaca

SEQ ID NO: 442215 - DNA, 284 bp, Homo sapiens
tgcttagcctttctatacatctggtgcagcatattggctaatccactgtacataataactgttagcagtcccattcattcttcagtcctagaggtatcagcataatcaaagaatgatgcaaattaagttaattgtggtgttcctttatttttacattgaaggcacagttaaatgaaacactcacaaaacttagaactgaacaaaatgaaagacagaaggtagctggtgatttgcataaggtaggcactgttcgtcctagagatgtagtatcatgagcctgtgtt

SEQ ID NO: 442216 - DNA, 455 bp, Homo sapiens
agagacggggtttcaccgtgttagccaggatggtcttgatctcctgaccttgtgatccgcccgccttggcctcccaaagtgttgggattacaggcgtgagccactgcgcctagccttgtatgcctttatacttgataagttttagtttagttcaatcagctggtctgtgagtactacccaaaatatacttttttcagtgtctaagatttttgctttttatggtcatgtaacattttcatttagagttctgattaatttattatcagattaaaaggaaaagaggaacagatgaataccatgaaggctgttttggaagagaaagagaaagacctagccaatacagggaagtggttacaggtgagaaattaaaaacaataaaaaatagcctttttatacttgactatcaatttaatttacacctattctttttaaggatcttcaagaagaaaatgaat

SEQ ID NO: 442217 - DNA, 371 bp, Homo sapiens
caggcctgtcaacttgttttattctaaatgtcttgtgatatgtaattcgtgactactggctgttggtgatcaaacttgctttcagaatgatagttactctttattgaacacttaccatgggccagatactttcataacaatttatatacattaacttctcttaaaatttaaagctgttatgattattgtatagctataaagctttctcttaaatacttttatgttgacactatttttctttcttagacctccgcttcagttctagcagaagaattacataaagtgtaagcctaccttttcacactcttataattgtgtagtcaccactaactgatacttgttagatgcgacacttatgattaactttatac

SEQ ID NO: 442218 - DNA, 4568 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442219 - DNA, 440 bp, Homo sapiens
tactactactaaaattcgcggccgcgtcgacaaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactttaaatcagtagtctaacaaggatgtcgagcgggggcaaattta

SEQ ID NO: 442220 - DNA, 4655 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442221 - DNA, 4643 bp, Homo sapiens
ctttggaaaaatccatggaccactctcgacaccggcgaagttatcccttcctgtccccgaggggtgtgtcctagcgattcggcctgaccccttcagtttccaaaagtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442222 - DNA, 4643 bp, Homo sapiens
cgttcattctgactggagaaataaactgtccagtacgtaacagccacctcctctgagcagctgctcgagaaagaaccagtgcacaagaagtctaaaatggaagcgatgatcaggataaaatggtgggaactctcatggtaccgatcacagaggcatgaagattgcccctccagcaagagactaaacaagaaagtggatcaggcaagaagaaagcttcatcaaagaaacaaaagacagaaaatgtcttcgtagatgaaccccttattcatgcaactacttatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442223 - DNA, 4652 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442224 - DNA, 3476 bp, Homo sapiens
gcagtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442225 - DNA, 4625 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttgaagagatgcggccagatcctctccattcatatttcgtcatcgacgggacagtccactg

SEQ ID NO: 442226 - DNA, 4385 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaaga

SEQ ID NO: 442227 - DNA, 4645 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttaggagcgttttgtctcactttagagtgatcatcctctggcctaccttgacacatgctctccttcaaaatgctaattcagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442228 - DNA, 4232 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtctccttctcagaagatccgtttctggggaacatcactattttcagtaacagtagtgtctccagcagctttgtcgacggctggggaatttagtagtagtaggc

SEQ ID NO: 442229 - DNA, 1281 bp, Homo sapiens
cacgtcgtatataggtagatcgaccatctctgcctatactagtaccatttccaaaggtgtctgtcccttctaatatgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttga

SEQ ID NO: 442230 - DNA, 4023 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcacagtcactggagctatccgtcaaaatgttaagtgtgggacctctgtttggaatgggggtccccaaa

SEQ ID NO: 442231 - DNA, 3569 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgagggcatggtaatgcagcagcagcagcagcgctggagacattgaacccgtgtgaaaagagccaggacactggaggccagcagatagcagtgtcagtctttccttctagttttgccacttcgttttctgtgtatacttggctcagtttcctaacttacttgagctgtggtttccctatctatagaatgggaataaatacctcatggggttgttgtaacggtgagaatttgtgaactgccaagtacagtggttggcatatattaagtaataaatggtgattattggctttttaaat

SEQ ID NO: 442232 - DNA, 2768 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgtaagtgataacattattataaactggtttttcttctttggtccattttttttttgtgtgtgcttagaaatctagttttattgtgcagttgggacagctgatgtatgtttaactttcactctataatttttcttaatggaataagagaacttagctgtgctttcccaaattcagtataa

SEQ ID NO: 442233 - DNA, 2436 bp, Homo sapiens
  misc_feature (2392)..(2392): n is a, c, g, or t
  misc_feature (2394)..(2394): n is a, c, g, or t
  misc_feature (2402)..(2402): n is a, c, g, or t
  misc_feature (2414)..(2414): n is a, c, g, or t
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggacaaatggaaaatgcantnaagaaaangatggtctgtantactgcttagggtcctctaggc

SEQ ID NO: 442234 - DNA, 2019 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgagggaaggctggagaggatttgaaaagggcaataaagagagacacatgggcagaccaagagaccgcctgactcctgaagctctcccttcacctatcttga

SEQ ID NO: 442235 - DNA, 1548 bp, Homo sapiens
cgccccgaagccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttaggga

SEQ ID NO: 442236 - DNA, 1521 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442237 - DNA, 357 bp, Homo sapiens
ctgcacagatgaggcactgataatggcctgcaggtcactcatctgcacagatgaggcactgataatgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442238 - DNA, 1570 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattcaaaaaaaaaaaatataaaataatataataccgaaggcggccgcaagctta

SEQ ID NO: 442239 - DNA, 1592 bp, Homo sapiens
agcgcgagcgcgcgcccgcgttctcctggcgggcttggtatttggcgcctgcgcgctgagtgcgtgccgctccgccgaccgaagaggctggtaagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442240 - DNA, 1477 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtgggctagtactgggatcctctagaccaccgccagca

SEQ ID NO: 442241 - DNA, 1377 bp, Homo sapiens
  misc_feature (1377)..(1377): n is a, c, g, or t
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctcacaattcaccagagctatattcaagacatgaatttgtttacacgcagttctcatcccttgggacgaggggatcactn

SEQ ID NO: 442242 - DNA, 1166 bp, Homo sapiens
atggtggaggtggaggatatgatggttaccaatgaaggaggaaatttggcggtggtaactatggtggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442243 - DNA, 1974 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtatgctgttcttttaggaatcttgccccacaggcctaagagaagagtagggggctgtaggaatgccatagctgtgtcactttcctttttgtctcctcatttctacttgtaggaactggtgatgaggaagacctgttgggccctgtaattataaataattgtgagaaaaaacagctatcatttaagcatttggggagcagaataatttgtaagagacaaagatttgctacaaaataagaagcagcagtgttacagcctgaggtccattggcctctcaaaagggaagaggttggcagtatcaattagaggctcatagactatattagggacaatctcagggaagtattttgcatgtgatggaagaatgacccaaggtctttggattgctaataataatactgttctgtgtcaagcctgcttggccacagaccaactctggtatcttattttcaggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442244 - DNA, 1462 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatgccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442245 - DNA, 2069 bp, Homo sapiens
agcgcgagcgcgcgcccgcgttctcctggcgggcttggtatttggcgcctgcgcgctgagtgcgtgccgctccgccgaccgaagaggctggtaagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtatagtaaggacactgttctctctgtgtgtgctctctactggaggaaagggattcaaagtcatactccattgattggggcctggtcctgccttagatctcagcttttggcttataggttccctggctttggatgtcttgagatttatttgaagaatgtattattattatgtgtgtatttgaagaatgtattatttgatatgtgacagaagtgctggaatttctaaaagagaacattaagccactaaaaacgttaccaagctccagcacttatgtgatgggtttgaaaaaacagaaagtggtatgacgctgtgggaggatgaaaatgacagtggcagggactgagagctgacaagccttggcagcacttaggtcggaagggggaggggggcaccccaaacaggacagtgtaactctgcactcttctactgaggctttaaaaaaaaaaaaactgactatttccatatttgctgtttggtagcttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442246 - DNA, 1245 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtattctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442247 - DNA, 828 bp, Homo sapiens
gcaaaaaatttcctgggacatttttctggcttatttcatcccccaaacataattaattcttcttggttttcttttccctagaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442248 - DNA, 663 bp, Homo sapiens
  misc_feature (2)..(2): n is a, c, g, or t
  misc_feature (13)..(13): n is a, c, g, or t
gnacgagctcgtngaattcggcagagggaagttccacgtcagtcagtctgacggtcagtggatcggtgggtttatctcaagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442249 - DNA, 909 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtactttcttctcgacgggtaccctgagatcttgggcacaacatagtgatctcatgcgaactgtcgtgaacaattctacctggctcctgacccaaagtcttgggaccatccttgtgttgggggcggaattcccgttttaccaccgcttggttccacaggctgtaaaaaccgttttccagccggttggaccca

SEQ ID NO: 442250 - DNA, 655 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacaggtgatcatggagggatgattccctgatgagaatcccaaggtaccctcggagttctcctgtctgcccagacaacttttcttctaggcagtaataccataatagagacagtgccctggacaggagccagctcaactgacttaatacacttgggcagttctgcaacttctcttcctctccttatttttccaaccctttcttttctttaccgccactcttgttcttttcctgaggtttggaacattcagttcgctctgtgttgtgggatttgttgacaggcacatttctttatcgctgtcacaaggattgggacagctttgcggggagtgagtgcttgaggggaacctcgtaga

SEQ ID NO: 442251 - DNA, 383 bp, Homo sapiens
caagggtcgcggctccccggcgctctctgccgccctctaccggaaccgagggagccagacagctgcgatattgggaaggcctccggagccgcgaagagcgcagcgcgagcgcgcgcccgcgttctcctggcgggcttggtatttggcgcctgcgcgctgagtgcgtgccgctccgccgaccgaagaggctggtaagtcctcaagctggcaggtggtcgggggagcggccggagaggagctgccgggagttcgtgccctgcaggtctgcgacgctggcgttcgctcctgcctgggccactttggtgggctcagagcatcgctttttgccaaggggcgtgacctgagcccgcctcctggggctggggggtggagaggaatgggaa

SEQ ID NO: 442252 - DNA, 1464 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442253 - DNA, 1535 bp, Homo sapiens
agcgcgagcgcgcgcccgcgttctcctggcgggcttggtatttggcgcctgcgcgctgagtgcgtgccgctccgccgaccgaagaggctggtaagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442254 - DNA, 2014 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaacgtgagttacctgcttctcacctgttaatacctacttctgtccctaatctctttctgtatgtatgaatgccagttaattctttgaaaactacacatgttcttataagttccccattttccttataactgtttgcccaagcaagatatctctgcccccatcacaatctggggaaagaaacttgaagctggaaatgctttgaaggtcaaggaatggaatcagaagaaactgggaaagtggagtgttctgggaggtgtgggactgtctctgtccacatagctcctttcttcagcttttcttcccagagtgcaaacagtgtttaaaggagttttaaaaggtttctcctgcttcactgcttcttaactggtttatggttcctggctcttggaacttccctttcagctcccttctctttcctggttttgtgtttaatcttgacacattgaaccttgatatctgactgcctggggtcggtcatgtgctgtgtcatttgcagtaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442255 - DNA, 2451 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtatgctgttcttttaggaatcttgccccacaggcctaagagaagagtagggggctgtaggaatgccatagctgtgtcactttcctttttgtctcctcatttctacttgtaggaactggtgatgaggaagacctgttgggccctgtaattataaataattgtgagaaaaaacagctatcatttaagcatttggggagcagaataatttgtaagagacaaagatttgctacaaaataagaagcagcagtgttacagcctgaggtccattggcctctcaaaagggaagaggttggcagtatcaattagaggctcatagactatattagggacaatctcagggaagtattttgcatgtgatggaagaatgacccaaggtctttggattgctaataataatactgttctgtgtcaagcctgcttggccacagaccaactctggtatcttattttcaggtgaattttaccgggaaggccgagatgggaggaccgttttcctatgtgtatagtaaggacactgttctctctgtgtgtgctctctactggaggaaagggattcaaagtcatactccattgattggggcctggtcctgccttagatctcagcttttggcttataggttccctggctttggatgtcttgagatttatttgaagaatgtattattattatgtgtgtatttgaagaatgtattatttgatatgtgacagaagtgctggaatttctaaaagagaacattaagccactaaaaacgttaccaagctccagcacttatgtgatgggtttgaaaaaacagaaagtggtatgacgctgtgggaggatgaaaatgacagtggcagggactgagagctgacaagccttggcagcacttaggtcggaagggggaggggggcaccccaaacaggacagtgtaactctgcactcttctactgaggctttaaaaaaaaaaaaactgactatttccatatttgctgtttggtagcttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442256 - DNA, 1533 bp, Homo sapiens
agcgcgagcgcgcgcccgcgttctcctggcgggcttggtatttggcgcctgcgcgctgagtgcgtgccgctccgccgaccgaagaggctggtaagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatgccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442257 - DNA, 1341 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtcgcagcagagagggaccatccaaatacctaagagaaaacagacctagtcaggatatgaatttgtttcagctgttcccaaaggcctgggagctttttgaaaagaaagaaaaaagtgtgttggcttttttttttttttagaaagttagaattgtttttaccaagagtctatgtggggcttgattcacccttcatccattggctggaacatggattggggatttgatagaaaaataaaccctgcttttgattca

SEQ ID NO: 442258 - DNA, 1655 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtatagtaaggacactgttctctctgtgtgtgctctctactggaggaaagggattcaaagtcatactccattgattggggcctggtcctgccttagatctcagcttttggcttataggttccctggctttggatgtcttgagatttatttgaagaatgtattattattatgtgtgtatttgaagaatgtattatttgatatgtgacagaagtgctggaatttctaaaagagaacattaagccactaaaaacgttaccaagctccagcacttatgtgatgggtttgaaaaaacagaaagtggtatgacgctgtgggaggatgaaaatgacagtggcagggactgagagctgacaagccttggcagcacttaggtcggaagggggaggggggcaccccaaacaggacagtgtaactctgcactcttctactgaggctttaaaaaaaaaaaaactgactatttccatatttgctgtttggtagcttcttctgcacggtacctgagatcctggtgcacaacatagtgatcttcatgcggtgcgtctctcttccctatcccgatggcctgtccggccatgtgagcctaccacctttgctcaggaggcccctgtgtgaccacagggcagaggcacctagcccgaggggacaccctgtgcctcacaggcacagatacagtagacccttggtgttctctaaacacagtgtccacatgcccttcacaaatcaccagtcaccctgagcagtcaaacattttctccataaaatgggtctagtttaactaaacacttgatcccctcagaatcctaatgagacagtcatgaacagaaaagctttctcaagatgttaagtactgggcatttgaccagacttcctctctagccacacaaattaccacatgtcatggacctttagggttgttttctggaagcatggctgttaaa

SEQ ID NO: 442259 - DNA, 954 bp, Homo sapiens
agcgcgagcgcgcgcccgcgttctcctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacaggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaattatacgaacacaaaaaaaaaggggcgtccaaatatcccgaggccagtttagcttaccgttctggaaagggcctaaggggccgtaaagcaggcggcgcgtaaagtcgctggaactgcctggctggaggcccttcggggccactggcccccggtacgtcgataatagtggtcaccttcgtgatgtgtataaacct

SEQ ID NO: 442260 - DNA, 497 bp, Homo sapiens
caaacagtgtttaaaggagttttaaaaggtttctcctgcttcactgcttcttaactggtttatggttcctggctcttggaacttccctttcagctcccttctctttcctggttttgtgtttaatcttgacacattgaaccttgatatctgactgcctggggtcggtcatgtgctgtgtcatttgcagtaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggtaagccttagggtttcattccctgggttgtgcacctgccaggctgggacccaggacacttacacttgtttcctgacttgccctgatgtaggccaccctgaaaatcaggaactccaacttctacacggtggcagtgaccagcctgtccag

SEQ ID NO: 442261 - DNA, 3173 bp, Homo sapiens
tgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtttaacggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaaggtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaaggaattta

SEQ ID NO: 442262 - DNA, 3926 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442263 - DNA, 468 bp, Homo sapiens
  misc_feature (41)..(41): n is a, c, g, or t
  misc_feature (45)..(45): n is a, c, g, or t
cccaaaacattataactttttctttttttgttgagacggancacntctttgtcactcaggctggagtgcggtggcacaatcttggctcactgcaacctctacctcccaggttcaagcaattttcccacctcagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442264 - DNA, 312 bp, Homo sapiens
  misc_feature (52)..(52): n is a, c, g, or t
gcgtagaatcgagccggtaccttttctcccctcaaaattaccaaaccatccnaacttcagatgttcaaagatggattgcatgaccctaccatcatttagttacctttttgttgcttaattttcctttgggaaaaagagataaatttaatgttggatgtagtcttcactcttcaagcaaatatgggatggatgggaaaggagggagtatagaagggactatatagtatgctttgaacttggaattggaggaaaggtgcttggaaaaactctcaagctctgttactccactgtttttacactaaaacaacaata

SEQ ID NO: 442265 - DNA, 3789 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442266 - DNA, 4323 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccaggtactctagaacttctcatacttaatgagtgttagtttcatgggtcattaaaaaagttaacataggtaaagcactgaagaatatctggcacatgttcaattacatatggaagttttagataatagatagtagctgaagaagcaggctgaggccgggcgctgtggctcacgcctgtaatcccagcactttgggaggccgaggtgggcagatcacgaggtcagcagatgaagaccagcctggctaacatggtgaaaccccatctctactaaaaacacaaaaaattggtcgggcgtggtagcgggcacctgtaatcccagctacttgggaggctgaggcaggagaatcgtgtgaacccgggaagtggaggttgcagggagctgagatcatgccattgcactccagcctgggcaacaaaagtgaaactctgtctcaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442267 - DNA, 3848 bp, Homo sapiens
agaccaagactccgtctccaaaaaaaaaaaaaaaaaatgccaattagatattctagaaatgcaattggaattcacatttaaaaatcggtaaagcaacctgttttacttgattatgttgttcttttgtttttttaccccccaagaaagagggtcttgctctgtcacccgggctggagtgtaatggcccaatcatagctcactacagcttcgacctccgacctcagctccctgagtgcctgggactacaggcgggcaccatcacacctggttcccaactagaaatgttctgataatagaaagtgaaaaacaaaagttagattaaaaaaaaaagggatgatatgagcctggagaagaacagaataatgaggacagaggagaagttaggagcctctcactttgctaattctactttgtctttgattaaccttacaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442268 - DNA, 3468 bp, Homo sapiens
aggactcagtctgggtgagagaacaagattcacctcaaaaaaaggatgggccaggcgcagtggctcatgcctgtaatccagcattataagaggccgaggcgggtcacctgaggtcaggagttcaagacctgcctgaaacaacatggagaaaccctgtctctactaaaaatacaaaaattagccgggcatgggggcgcatgcctgtaatcccagctacttgggaggctgaggcaggagaatcgtgtgaacccgggaagtggaggttgcagggagctgagatcatgccattgcactccagcctgggcaacaaaagtgaaactctgtctcaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442269 - DNA, 3340 bp, Homo sapiens
ttctgattactcctgagtaaaattttcagcccctaaagaatgaggtgaaaaggcgggtttaggaatggatgctatcaggcagggtgtgatggctcatgcctgtaatccagcattataagaggccgaggcgggtcacctgaggtcaggagttcaagacctgcctgaaacaacatggagaaaccctgtctctactaaaaatacaaaaattagccgggcatgggggcgcatgcctgtaatcccagctacttgggaggctgaggcaggagaatcgtgtgaacccgggaagtggaggttgcagggagctgagattgtgccactgcactcctgcctgggtgacagatccagactaggagataagatacagaagataattcatttgcagaagggatattagtattgaacgaaaacctagaaaaaggacttcttacccactgggacttttaagtttatttttgagggttctgtgtaactggtgtgcagaattgcatcaaagctgcatgttttcttttctcctaggtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442270 - DNA, 3044 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcatcctggcctgagatcgtcctggcctgagatgggatccgtctagag

SEQ ID NO: 442271 - DNA, 2510 bp, Homo sapiens
  misc_feature (24)..(24): n is a, c, g, or t
acccacgcgtccggacccacgcgntcgcccacgcgtccgacccacgcgtccgcggacgcgtgggtcgcccacgcgtccgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442272 - DNA, 2239 bp, Homo sapiens
ggccaaggtgcctggagctgcatgaggaggtgggatatggtgccatgcgtggattgccagctggcaatccacgcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442273 - DNA, 1602 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggcctggtccaatttcaaagaaggtagcacagacccaatgccgggaagcgccccacagccagcgtatgcgtgcagcggccttgagggaagctctccctcaggacatcactggttgagggctcatctaagtagcagccccagagcagagactcaagggcagtgggtcgtggagtggggccttaggcgtggaggaac

SEQ ID NO: 442274 - DNA, 918 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggtattgactagaaactgggcaaggaagtgggctctaccagccacattgaggacaagtgtggagagttagggcagggaggtgatgatgcctttgaataagaacaccttgaattctaatcaagggaaacctagtccaactggccccgaatatgactgcccttgcttggagctctactaccctggagagctcccacccagctgtgcaagagatgaactgtgagtgattggcctttgcagtccagctagggatagttcagaattattccctagtaaactcaactatggggtttctagaaacatacttaatttacaaggtccgaagttgtttacttgtattataaatgtttttattattttacccaggattggtaggaattatttttgtctatggcaaatgtggataatgaca

SEQ ID NO: 442275 - DNA, 401 bp, Homo sapiens
ggttctgtgtaactggtgtgcagaattgcatcaaagctgcatgttttcttttctcctaggtgttctattactcaacaggaatcttcaaggatgcaggtgttcaagagcccatctatgccaccatcggcgcgggtgtggttaatactatcttcactgtagtttctgtaagttggatggtttggtaattttgaggggagaaaagaatccttgctacagatgttcaaagatggattgcatgaccctaccatcatttagttacctttttgttgcttaattttcctttgggaaaaagagataaatttaatgttggatgtagtcttcactcttcaagcaaatatgggatggatgggaaaggagggagtatagaagggactatatagtatgctttgaacttggaattg

SEQ ID NO: 442276 - DNA, 3748 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggggggccgtatccagtattggagcgaggggagataggtaccggacggtgatgaggaaacactgcctgctggcagggaccgttaaaaaagtcttccgtgtaggaggacggctgatgccaagggggggggatcaaaggtcacatggggtgaatgaaaggctcgctcttttctatttcgatag

SEQ ID NO: 442277 - DNA, 3612 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442278 - DNA, 4245 bp, Homo sapiens
agaccaagactccgtctccaaaaaaaaaaaaaaaaaatgccaattagatattctagaaatgcaattggaattcacatttaaaaatcggtaaagcaacctgttttacttgattatgttgttcttttgtttttttaccccccaagaaagagggtcttgctctgtcacccgggctggagtgtaatggcccaatcatagctcactacagcttcgacctccgacctcagctccctgagtgcctgggactacaggcgggcaccatcacacctggttcccaactagaaatgttctgataatagaaagtgaaaaacaaaagttagattaaaaaaaaaagggatgatatgagcctggagaagaacagaataatgaggacagaggagaagttaggagcctctcactttgctaattctactttgtctttgattaaccttacaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccaggtactctagaacttctcatacttaatgagtgttagtttcatgggtcattaaaaaagttaacataggtaaagcactgaagaatatctggcacatgttcaattacatatggaagttttagataatagatagtagctgaagaagcaggctgaggccgggcgctgtggctcacgcctgtaatcccagcactttgggaggccgaggtgggcagatcacgaggtcagcagatgaagaccagcctggctaacatggtgaaaccccatctctactaaaaacacaaaaaattggtcgggcgtggtagcgggcacctgtaatcccagctacttgggaggctgaggcaggagaatcgtgtgaacccgggaagtggaggttgcagggagctgagatcatgccattgcactccagcctgggcaacaaaagtgaaactctgtctcaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgaaaaaaaaaaat

SEQ ID NO: 442279 - DNA, 2598 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttccttt

SEQ ID NO: 442280 - DNA, 2238 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccataaaactcaagtaattttgccacgtagagctgtatggaagtgaggaaggtgctcttacatacagctctac

SEQ ID NO: 442281 - DNA, 1311 bp, Homo sapiens
gtggggtggggtggggctgggggcttgtcgccctttcaggctccaccctttgcggagattataaatagtcatgatcccagcgagacccagagatgctgtaatggtgagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgagtgtgatactttagggtcaaacgtgtcttaaagtatttcacttaaaatgccgggcatggtggcggtgtgcctctgtagtcccagctactcaggaggctgaggtaagaggatcgcttgagctcaggagtttcaggttgcagtgagctataattatgccactgcattccagcctgggagacagagtgagactgtgtctctgaaattt

SEQ ID NO: 442282 - DNA, 1628 bp, Homo sapiens
  misc_feature (1)..(1): n is a, c, g, or t
  misc_feature (21)..(21): n is a, c, g, or t
ntctgtgggcactctggcaanccgtagcaggaggaacgacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatatt

SEQ ID NO: 442283 - DNA, 1088 bp, Homo sapiens
ttcccaaatactacgtaataaacaccattgtctcatgcatctgtatatattaccataccttttctctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatatt

SEQ ID NO: 442284 - DNA, 853 bp, Homo sapiens
tctctagcctaatgtgatcaaacctttacctagaatggaactttgcatagtaggtcgattgtactttcagctgcatcagacagctttgtccctaaattattattttgccgatgttttcagggatgaacaagaaacagaaggtgtcagccaaggacgagccagcttcaagcagtaaaagcagcaatacatcacaggtgttgtagtgactttagtgactgcttatgattagtgaactgtggcctcatcagccagcagagcatggaaaaataggctttttaagtctgaaaaattatttaatgtggtcattacttataaaggaataaaactcactctgaaatgcagtaactgaattgcctctatacaataattaatcaacagatatttatttatctcccactataataccagagatactcctaggcagtagagtgtagtgatggccaaaagtagacacatattccgtctcttggagcctacatcctactgaggggtataaataaattaaatacatatttagatagatagaatgctagatattatgaagaaaaataaatcagggaaatgagacatttaatgctgtcaggtggaagagggatctgggatgaatgttaaatgggatggtcaggaaaggatactctgagaaggtgacatttgagtcaagacctacagatgatgagtgcgtgagccatgtgactctctaggagaaagaacattctgggcagagagtagaatgaccatcaatcccatgttgtttcagagaaaacaagtatattctgggaaaattaaaaaatcatctgataagtagtgtgactttaaatttaaaaaaagagagtatagctaatctaatatctga

SEQ ID NO: 442285 - DNA, 3602 bp, Homo sapiens
agcccctgcctcggccagaggtttcatttttaactgaatatttacgaaagctggaagcgtgcgaggggggtggggtggggtggaaatagcggctgcttcttttccagcgatttatttaatggggatgtgttcaaggcaagagcgaattcagaaggatatcgacgtcgtgatccagaagtccagagctgagaaggactgcctgttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggaggacaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatatt

SEQ ID NO: 442286 - DNA, 3503 bp, Homo sapiens
acccagtcgggggccgccgcatcccctcggacgcggcgcagagggacctcgccgccctctagcccttgccttctgcccggccaggcctcccctgacaccaccgaatgtggggctcaagtcctgatcggggttaaaacaaatccactccaggggtagcttctgacgggactttctgtatcagattgcagatactctgactccacctgtacttatacctacgttggcggccccagaaggtatcctactcagtacatgtatctgaagattacccagataatacatatgtgtcaagttcagagaatgatgaagatgtgctagttactacagagccaataccagtaatttttcatagaatagcaacaggaatcaagacagaatagtacagtggaggaagattctgaaggtgacaatgattccgaagaattttattacggaggacaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatatt

SEQ ID NO: 442287 - DNA, 2043 bp, Homo sapiens
tcctctaccatgaaaggacacagcaagaagatcaatttgtggccttactgtcactctggtctatgaatcagcagatgggccctcatcaggcactgaatctcctgacatctttatcttcccagccttcaaaactcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatatt

SEQ ID NO: 442288 - DNA, 3083 bp, Homo sapiens
agcccctgcctcggccagaggtttcatttttaactgaatatttacgaaagctggaagcgtgcgaggggggtggggtggggtggaaatagcggctgcttcttttccagcgatttatttaatggggatgtgttcaaggcaagagcgaattcagaaggatatcgacgtcgtgatccagaagtccagagctgagaaggactgcctgttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggaggacaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacaggtgttgtagtgactttagtgactgcttatgattagtgaactgtggcctcatcagccagcagagcatggaaaaataggctttttaagtctgaaaaattatttaatgtggtcattacttataaaggaataaaactcactctgaaatgcagtaactgaattgcctctatacaataattaatcaacagatatttatttatctcccactataataccagagatactcctaggcagtagagtgtagtgatggccaaaagtagacacatattccgtctcttggagcctacatcctactgaggggtataaataaattaaatacatatttagatagatagaatgctagatattatgaagaaaaataaatcagggaaatgagacatttaatgctgtcaggtggaagagggatctgggatgaatgttaaatgggatggtcaggaaaggatactctgagaaggtgacatttgagtcaagacctacagatgatgagtgcgtgagccatgtgactctctaggagaaagaacattctgggcagagagtagaatgaccatcaatcccatgttgtttcagagaaaacaagtatattctgggaaaattaaaaaatcatctgataagtagtgtgactttaaatttaaaaaaagagagtatagctaatctaatatctga

SEQ ID NO: 442289 - DNA, 924 bp, Homo sapiens
agcccctgcctcggccagaggtttcatttttaactgaatatttacgaaagctggaagcgtgcgaggggggtggggtggggtggaaatagcggctgcttcttttccagcgatttatttaatggggatgtgttcaaggcaagagcgaattcagaaggatatcgacgtcgtgatccagaagtccagagctgagaaggactgcctgttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggaggacaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgtatcctactcagtacatgtatctgaagattacccagataatacatatgtgtcaagttcagagaatgatgaagatgtgctagttactacagagccaataccagtaatttttcatagaatagcaaagaccccaaaag

SEQ ID NO: 442290 - DNA, 332 bp, Homo sapiens
tgaaatgttgtgaatttaattttgatattgagagttggaaaaaagttttgtgattgattcctttttcttttgtagcctaccgtatgtgaacgggagctgtgtgtgtttgcttttcaaaccctgggagtaatgaatgaagctgctgatgaaatagcaactggagctcaggtagtaacacaggatactaattatttcttattttgctttgaaaaatttgttccagtccactagttatcttcattctgctattctttggggaaaatatttgataacttctagttaagtggcaaattggcatttgattttttttatatgtaaactaaatgtgatct

SEQ ID NO: 442291 - DNA, 319 bp, Homo sapiens
tgaagtttatgcatactccacatcagttccttcttctcagcagtccaccagccaaagaatccaattttagagctgctaaaaaactctttggaagcacctttgcatttcagtgagtaaggcttaatgttaatgggggtgtgctcccattaacattttccagaaatgtatggggaagatatcactgtctttcagtaaatgatcattcagtagatggtcattcaacagatggtcatgtagtcaactacataatacttgatttggcaatccagaaccttcagaaggcaccatgacttattatgttttgaccactttgaagata

SEQ ID NO: 442292 - DNA, 403 bp, Homo sapiens
caacacacggtagttatataggacatgaacttgctgtctacatagttcttaagtcaggacctatctgcttttggtaatacttagatgagtccctttttattgttataccagttgttattcaaattataaagttgttacatggtctttcactgtttttatctatatttcttcatagacaataaggctaaacaatttttatgtgttcattagtgcttgtatttttgctttagatttcaacgagaagagatatattaagtcggaatggactaggattcctttagaataaagtggttctttaattttattttccacttaacagtgatcacctcatctgacctgcacaaacatggagagatatgggttgtccccaatactgaccatgtctgcacacgattctttttcg

SEQ ID NO: 442293 - DNA, 413 bp, Homo sapiens
aaaaaaaaaatggaagaaaggggaaaatttaggcatgacatagaatgggctgttctgtgtttcgcaatgagaacacattgttaaatacacctgaaaaacaaccgtataatttgcttttgattctcttgggctatattttaggtatcaaatagcatttctaagctgttttaaatgctgccatcttttaaaatgtttttatatttttatgttttgtatttcagctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttatt

SEQ ID NO: 442294 - DNA, 468 bp, Homo sapiens
gcctactactactaaattcgcggccgcgtcgattaactgttgcttatccataaaatccaaattacaaaaggaaaatggggaggaatcaagacagaatagtacagtggaggaagattctgaaggtgacaatgattccgaagaattttattacggaggacaggtgaactatgatggggaactgcacaagcacccacaactggaagctgatttgtcagcagttagagagatatatgggccacatgcagtttctctcaggtaaataagtatcactggtgaataaaattaaagttttatggtaagtcattgaaatttacttttggagtaatttaaaggaaaaatttggggttttaattgtattttaaagtgttttagaaagagtctactgtttatccttacacaaaatgacatatttatggctatttttttgatacatgtggtttaagattacattgattgcattaaaaatta

SEQ ID NO: 442295 - DNA, 3666 bp, Homo sapiens
cagagcagtatctcatttctgaacacctggattgtagctttcccttgactgtcaaaggaggtggttttaaaatcaagccaaacaggtttccatcttttaggaagaccctggaacgtgccagttgattctgaccatttctcatgaacagaaacacctaggaagggagaactgggatttatttaatggggatgtgttcaaggcaagagcgaattcagaaggatatcgacgtcgtgatccagaagtccagagctgagaaggactgcctgttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggaggacaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatatt

SEQ ID NO: 442296 - DNA, 1883 bp, Homo sapiens
agaaacaatggcaaagcactggataaaacctgaagggtagtaactatcttatgtgtatatttcaaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaactgttttgtgctgatatttttatactaaactctttaactggatatttggtattatataccgacattttaggttaccaaaatagaattgagaacattttataatggcatctaaatctatcagatactttgcaataagtatactgtttgcacattctgatgtgctatatcattagtagtatgggcattctaatgttttggaaggggtgttccctattctatttttcttcataaaaaaagaagtaggtcttagaagcagtgctttgccaaaaagtatgtaatatacacatctatacattcatgcatcaaaatgtgtggttgtgaatatatttgtgtatattcacacgtatgttttgacaagaaagatggcttagcttcacaattctatcctcgtttaatggaaagaagataatatttagtaagcaataaatttggacataaatcaagatatgagccagatttaccaccattcattcactgaaaatatttgcagacaatttttctgtttgtctgaagaaattcagcccttttaaaatgttatctaaaagtcataatttggggaacatacatggcctggtagaccgaatctatattcaaatgattatgtatttaaaagaaagacctcagaatttaaagaaaccatatatatt

SEQ ID NO: 442297 - DNA, 2490 bp, Homo sapiens
agcccctgcctcggccagaggtttcatttttaactgaatatttacgaaagctggaagcgtgcgaggggggtggggtggggtggaaatagcggctgcttcttttccagcgatttatttaatggggatgtgttcaaggcaagagcgaattcagaaggatatcgacgtcgtgatccagaagtccagagctgagaaggactgcctgttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggaggacaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgacaagaaacagaagtgtcaccaaggacgcacccgcgtcaagcagtaacacacccatacaccacagtcacagcgacaggtccagccaagccgatacgcctacagccgaactaaaagcatccggtaccgagctcgat

SEQ ID NO: 442298 - DNA, 985 bp, Homo sapiens
ggtttcaccatgttggccaggctggtctcaaactcctgacttcaggtgatccgcctgcctcagcctcccaaagttctgggattacagacatgagccaccatgcccagccctggcctctgatttttaagtgagatcattgcattcttttctcatcatcctccccattcccattgctccccgtaagagtgactttgtcttgctctggcttgtggttggataagaaccaaagctcacgaagctgtggggcaccctgtttaccacaggatcggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgaggtttgtttttctatctagcagccagcctgctgtctgggaaggctatcttggggctttgtttctagtttctggaatatatgtgcagtagtatgaagaaaggagctggtttatatatatgtgctatttattgagaacttatgcaccagggtttatatcacaaatagtatatatcatatatattagctcattaattctcacaataatgtatgagagtggtatttccttgttatagatcaagctgaggttcaggttaataactgcctgaagtcacaaacagctggcaatgggcagagctgagactcatatccatagcctgtgcttttagttactctttactctgccagaccaaatctttgactttgtgcattgccttcatctcaggaaagtggaggagagctctttatgagaagtctgctgtagaaatttagtctttttacaattttttaaaaaaatttagtctttatacaacccccttcatagtaccccttagtctctcccatctaagaagttccttcttcaggatctgaaatgatttgcca

SEQ ID NO: 442299 - DNA, 3282 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442300 - DNA, 3270 bp, Homo sapiens
cacgcgtcgccacgcgtcgccgcgacaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442301 - DNA, 3362 bp, Homo sapiens
cacgcgtcgccacgcgtcgccgcgacaggaaacgggaaagatggcgacggctccgcgacgttgaggccgcgttgggcggttcagactcagggtgagatggggtttcaccgtgttggccaggatggtctcaatctcctgacctcatgatctgcccgctttggcctccaaaagtgctaggattacacgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442302 - DNA, 3112 bp, Homo sapiens
cgcctgcgtaaacttcggctaggtagcgaaggctggtggttcggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442303 - DNA, 3333 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgttaaaaaaaaaaaaaacacacaacaaaaacaaaaaaaacacaacaacaaaacaa

SEQ ID NO: 442304 - DNA, 2062 bp, Homo sapiens
ggtttcaccatgttggccaggctggtctcaaactcctgacttcaggtgatccgcctgcctcagcctcccaaagttctgggattacagacatgagccaccatgcccagccctggcctctgatttttaagtgagatcattgcattcttttctcatcatcctccccattcccattgctccccgtaagagtgactttgtcttgctctggcttgtggttggataagaaccaaagctcacgaagctgtggggcaccctgtttaccacaggatcggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442305 - DNA, 2906 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccaactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442306 - DNA, 1507 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacacttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442307 - DNA, 2205 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgaggtttgtttttctatctagcagccagcctgctgtctgggaaggctatcttggggctttgtttctagtttctggaatatatgtgcagtagtatgaagaaaggagctggtttatatatatgtgctatttattgagaacttatgcaccagggtttatatcacaaatagtatatatcatatatattagctcattaattctcacaataatgtatgagagtggtatttccttgttatagatcaagctgaggttcaggttaataactgcctgaagtcacaaacagctggcaatgggcagagctgagactcatatccatagcctgtgcttttagttactctttactctgccagaccaaatctttgactttgtgcattgccttcatctcaggaaagtggaggagagctctttatgagaagtctgctgtagaaatttagtctttttacaattttttaaaaaaatttagtctttatacaacccccttcatagtaccccttagtctctcccatctaagaagttccttcttcaggatctgaaatgatttgcca

SEQ ID NO: 442308 - DNA, 1111 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaaaagagtgcatggcggtaccgagctcatc

SEQ ID NO: 442309 - DNA, 846 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggtagatcctcaggaacgggcacgtcggggacgcagggagaggatcgacaaccgggataccccagtcaactgacggatgtagaaacggccggccagtagactccggctacaagcatggatagt

SEQ ID NO: 442310 - DNA, 389 bp, Homo sapiens
gggcgaggcttcattgcaggcattgacctcaagcagcagaagcgagagcagtcacgtttctatggagacctaatggagaagaggcgaaccctggaagaaaaggagcaggaggagtgagtgatcaaggctagggtggctggacagagcccagaggctctacagaaaggagttggagggcactgattctacttactcctcacaccctgctccagggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactc

SEQ ID NO: 442311 - DNA, 3116 bp, Homo sapiens
agctccggcagggaaagctacggctaggtagcgaggccgggtggtcggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442312 - DNA, 3566 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttgggtttgttattctaccctgtgtagcccctagatggaagaggaaagagtgggatgagatacagtgtctcttaggagagatagaaacctgttcactctggagtttggaaaggggaaggatggtgggagtttatgagaaaacatttttctgttagatctccatttaccccatatcataagtctacccctttttttcttcatttggggttcctcgtctggattccctccattccctctcctcttttcttccatgagctcttctgcagctttgctttctttggtctgcagaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442313 - DNA, 3335 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgttacacaaacaaaaaaaactgggaaaaacgcggagggagactaagagggaaaaagg

SEQ ID NO: 442314 - DNA, 1658 bp, Homo sapiens
gggcacctgctgggctataaatgattatactgtactcctcagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgtta

SEQ ID NO: 442315 - DNA, 2957 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccaactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgttaaaaaaaaaaaaaacacacaacaaaaacaaaaaaaacacaacaacaaaacaa

SEQ ID NO: 442316 - DNA, 2640 bp, Homo sapiens
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatgggggtgtgtctggcaggggagaacaaagtctagcctctgtggcactgctttctgaatctagcagggccccctaggctcttcctttcaagtctcaccctttctttaacctgtccagcaatcaacaagttaggaccagggtgaagggtggtttgagggaataaagagaatggaatcaattgctgggaccccctgtctgctgcagtaatgccagccaaagctgccttgggtcttcatcctggtgaggtggagccagggaaaggtttgagacccatatcctggcagtctgaggatgtagaaaagagtaggtgaaaactgcttaggtacgttgagaggaggtgatatggtcagaagggagctgataatcagtgtcctttactcctgtcactggtgcttgaggggaggggtgtgtccctgtcactcagctctccaacttccttaaacttcttgatccctgctttctaccctgatctcgc

SEQ ID NO: 442317 - DNA, 2157 bp, Homo sapiens
  misc_feature (2009)..(2009): n is a, c, g, or t
  misc_feature (2014)..(2014): n is a, c, g, or t
  misc_feature (2022)..(2022): n is a, c, g, or t
  misc_feature (2025)..(2025): n is a, c, g, or t
  misc_feature (2029)..(2029): n is a, c, g, or t
cgcggccgggggggtggggggtgttcatctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggctggagtgcagtggtgtgatcttggcttacagcaaccgttgcctcccaggctcatatcctcctacctcagcctcccaagtagctgggattacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagncatgntcacggcnacnatgncccagggggggagcgttgggcaggagtatcttcgggaactcgcggggggcacttgggtccggagggaacccagtggtgtggacaaaagttccccatggggagcgaaaggggaaagggggggacttggg

SEQ ID NO: 442318 - DNA, 333 bp, Homo sapiens
gaacgggagaccaatggaaatgaggatgaggaagggcggcagaagatccgggaagagaaggataagagcaaggaactgcatgccattaaggtgcaggccttggctccatcttcacttctctcccacacaaaaatgaggtttagttatttggccattgtgatctctgcatgtgagaattgggcctcaaagctcatgtgctttgtgttctgtccctgggtaggagcgttacctgggtggcatcaaaaagcggcgccgaacgagacatctcaatgaccggaaatttgtttttgagtgggatgcatctgaggacacatccattgactacaaccccct

SEQ ID NO: 442319 - DNA, 2370 bp, Homo sapiens
tcaacgttgtactgaaaattctagccactgcaatcatgttttaattgggagtagggggaaagagggagggaaggagaaaaatgaaaggccttcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctgattctgcgcctgactgtggaatgtattttctgacattaggtgcagactctttttctcttgggttttatttcccatccctccctccctctccctgcatatctttctttatgacctcctggcactagatggggaaagaacagagcagcagcagaaaatgctgctgttttttttttggacgagagcccataggagttgaaaaatcctgctgctctcagctatatttttttctccattatttataaatgtttgcttttaaactgattttattttccattctcccctggagttgggccaggggagagtggggtgggaagacagatccctgctgtgcagccagcaggaagtaggcacgcctgcccagtgacctttaaatagtcccagtgtttgcacttagcctgtgctggggacactggggataaactgcaggtggtctcatgtcagcctgatgcctaacctacaaagtgcttttgtgtccacgatcttacctggttcttatggagagccttgtgaggaagcagggattgttataccactgtgcagtcaagggaatcaaggcccacactggtttttggatccacccaaagccacagcttcagcctccttcatgaccccagagtttcctggcctgtttctggttgtgcctcctgtaactgcctgtgactgtttccctcgttttcatcagccaagccatctcctccctggccctccctgcccatctcttttggaagcttcttcctggatctgcaggatgttcactgtcccttgtgttccctttcagctcctccttgttgcctgactacgattagtgccctgtcttgtcagccagcattcctggccctccaggacctccagagtcatcctacaaatgacgtttatctggattgcctttctgttctttgcacagggccaactggtccactagggctcctcctctgtcactgctaaaccaaaggaagtggcctgctggttgtcccctttcttgtggctaattgctgaacctttctttgtcctactgtggctaagaactctgactggtttttttttttttttctttttgagatggagtctcactccgtcgcccaggctggagtgcagtggcgtgatctctgctcactgcaacctccacctcccgggttcaagcaa

SEQ ID NO: 442320 - DNA, 1048 bp, Homo sapiens
cccggtgggcaggtgcctgggcggggcgcgccgcggttggcgcctgggcggctgggcggctgcctagcacccggaagagccgtcaacttagcgagcgcaacaggctgccgctgaggagctggagctggtggggactgggccgcaatggacaagctgaagaaggtgctgagcgggcaggacacggaggaccggagcggcctgtccgagacaagccatgccaatcccactaccactcttcttcctacgaacaagccaggccaatcctactaccgctcttttcttcccacctgcagctagttcttttcgcaccttggcaaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagca

SEQ ID NO: 442321 - DNA, 923 bp, Homo sapiens
cggatagccccccgggtgtagctacagttgcctagtgagcgtggtgctgcgtcgctgctgaaagtgggccatgcgcgcggcatggagtcgccatgccctagacacccggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggatggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagca

SEQ ID NO: 442322 - DNA, 630 bp, Homo sapiens
cggatagccccccgggtgtagctacagttgcctagtgagcgtggtgctgcgtcgctgctgaaagtgggccatgcgcgcggcatggagtcgccatgccctagacacccggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagttgtgttttgcacttaccctgtgttctgccttttggtggcataacaagggacttgcacttatcttctgcattttgcagtctttggcattgacgtggcacagcctttccttcataccatttgcaagacaaacagaaaagtcaacaaaagacatgaatagatatttcctagaaaaggaaatatgaagagatgctcatcaccaccaaggagcagagaa

SEQ ID NO: 442323 - DNA, 1909 bp, Homo sapiens
tcaacgttgtactgaaaattctagccactgcaatcatgttttaattgggagtagggggaaagagggagggaaggagaaaaatgaaaggccttcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctgattctgcgcctgactgtggaatgtattttctgacattaggtgcagactctttttctcttgggttttatttcccatccctccctccctctccctgcatatctttctttatgacctcctggcactagatggggaaagaacagagcagcagcagaaaatgctgctgttttttttttggacgagagcccataggagttgaaaaatcctgctgctctcagctatatttttttctccattatttataaatgtttgcttttaaactgattttattttccattctcccctggagttgggccaggggagagtggggtgggaagacagatccctgctgtgcagccagcaggaagtaggcacgcctgcccagtgacctttaaatagtcccagtgtttgcacttagcctgtgctggggacactggggataaactgcaggtggtctcatgtcagcctgatgcctaacctacaaagtgcttttgtgtccacgatcttacctggttcttatggagagccttgtgaggaagcagggattgttataccactgtgcagtcaagggaatcaaggcccacactggtttttggatccacccaaagccacagcttcagcctccttcatgaccccaagagccacaccattgagccaccatatgagccccgccaagagccactcgaagtgcccatcctaggtgcac

SEQ ID NO: 442324 - DNA, 275 bp, Homo sapiens
caggcactgagcgtacgttctgctctgcgtagctgtggtccacccctccaaccctctccttgctgtgctttaatgtgtatgacatgtagattttcataacaggctgacagatagttttgctttgttttgtttttgagacagtttctgtcacccaggctggactcagctcactgcctgcctcagactcccaagtagctgggattacaggcatgcaccaccactcctggcaaaatttttttttttttttttttttttttttttttttgagacagagt

SEQ ID NO: 442325 - DNA, 2682 bp, Homo sapiens
cggggcgcggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442326 - DNA, 936 bp, Homo sapiens
cggggcgcggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcctctaggtcccacacgaccttttcctctgaaccaagcttcagacgatcgactgccgctgatgatgaggtcagaccccacgactactacggcctcccacggacc

SEQ ID NO: 442327 - DNA, 3076 bp, Homo sapiens
  misc_feature (1718)..(1718): n is a, c, g, or t
cggggcgcggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagaggtgggaatagggcttgggattcgagggtgggagttcatccagcatcagagtcctcctctctaactctgttatttgcctctcttgtgctgctggacccagagagaggtactatgcctattttccccctcctacacctggaccagatgcctggaagcacccaagctcccctcttctgccctgccccttcccnacccgctatgctccaccattaccctccacctcagcatgcttgcctgtctacccctcccccccaagaaggcagcacctatgggggaccagctgtgggcagaagccctggaggagctgtgatgggcagggaggacgtgggtggggtggggaccaggctcagcactggatggtactgggagacactgaggtgccccttccccaacagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442328 - DNA, 1950 bp, Homo sapiens
gcagagtgcctcccgggaatccttccccgcgcggccgcggcgccgcacagccgccgccattcgggctccagccccgtccgcgcgtctcccggcgtgggtgcgggaccagggcgctgcggggcgcgcaggattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442329 - DNA, 2184 bp, Homo sapiens
attcaggattgggggaggggagccagggcgaggaagaagaggtgtgagcagaaggggctggggtctcatgaacctccctttctcctcccttccccaccccccaaggagattccctagcatggtggtcctggcccctccctagcaagctccaagcgggggaggatcttgcctggcagacgctctgccctggtgagaagggggcgggatgagcttttctctgcagcccagcaccaggctgtgagcccagctggctgggctggaggggctgtgaggagggagggtggaggcaggaggggccgggaatgagcgccatgttctcccaggactttttcctggccattatcctgcaggacagcagcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442330 - DNA, 1332 bp, Homo sapiens
acgcaccctgtctgactacaacatccagaaagggtgcgcccatcctccatggtgctgatcagcacctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442331 - DNA, 1004 bp, Homo sapiens
cgggtgagcaaggtctgccaccatgatcaaccttctcttctttcccatagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442332 - DNA, 1721 bp, Homo sapiens
cggggcgcggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgtttgggaatcaattttacacacagcacgtgttatgatcaggatttccga

SEQ ID NO: 442333 - DNA, 664 bp, Homo sapiens
cggggcgcggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgagaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442334 - DNA, 2685 bp, Homo sapiens
gcagagtgcctcccgggaatccttccccgcgcggccgcggcgccgcacagccgccgccattcgggctccagccccgtccgcgcgtctcccggcgtgggtgcgggaccagggcgctgcggggcgcgcagggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442335 - DNA, 1901 bp, Homo sapiens
cagcggagtctgggcgctcccagccggtcctggtgctgcggttgccgaggagacgctgcagcctagctgggccctggcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442336 - DNA, 1947 bp, Homo sapiens
cggggcgcggccccgcggcccgcgcgctcctgggcgggggatgttgtgatggagaagccgcggcggagcccgaaccccgcagcctgagccacctccgtcatctgggcccggggcctcaccgcgcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442337 - DNA, 1846 bp, Homo sapiens
caagggtgtatgacacagatgcgagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgcttgtgttgggccccagggaactaaagggtgtgggtcagggaggggtctagaggctattcctaggcctcaggcctcccaaatatgcccctccccagtagctacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442338 - DNA, 2338 bp, Homo sapiens
cggggcgcggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaaggatgaacccagtgatgaggccccaatggagctgggactgaaggaacctgaggaggggacgttgaccttcccagctcagagcctcagcccagagccgttgccccaagaggaggagaagcttcccccacggaataccaacccagggatcaagtgtttcgccgtgcgctccctaggctgggtagagatgaccgaggaggagctggcccctggacgcagcagtgtggcagtcaacaattgcatccgtcagctctcttaccacaaaaacaacctgcatgaccccatgtctgggggctggggggaaggaaaggatctgctactgcagctggaggatgagacactaaagctagtggagccacagagccaggcactgctgcacgcccaacccatcatcagcatccgcgtgtggggcgtcgggcgggacagtggaagagagagggactttgcctacgtagctcgtgataagctgacccagatgctcaagtgccacgtgtttcgctgtgaggcacctgccaagaacatcgccaccagcctgcatgagatctgctctaagatcatggccgaacggcgtaatgcccgctgcttggtaaatggactctccctggaccactctaaacttgtggatgtccctttccaagtggaattcccagcgcctaagaatgagttggtccagaagttccaagtctattacctggggaatgtacctgttgctaaacctgttggggtagatgtgattaatggggccctcgagtcagtcctgtcctccagcagccgtgaacaatggaccccaagtcatgtcagtgtggcccctgctaccctcaccatcttgcaccagcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatgcttcgctaccagaagtgtctggatgcccgttcccaggcctccaaggcagtggtggggagagttttgacggtataaaagatgcttataaaagtttggtttggggtggaacctctactttagaggggcacccaggaaacttaaatttatattctttggcctgaataagtatttcaaaatttgcctttttttttttttttttttttttggaaacaatttccccctttttcccccgg

SEQ ID NO: 442339 - DNA, 1349 bp, Homo sapiens
cggggcgcggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaacgcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccagctcacctggacaggttttgctcatggagaaggctttgaggatggagaattttggaagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgc

SEQ ID NO: 442340 - DNA, 2471 bp, Homo sapiens
tttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctaattta

SEQ ID NO: 442341 - DNA, 2628 bp, Homo sapiens
tttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcagggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctaattta

SEQ ID NO: 442342 - DNA, 281 bp, Homo sapiens
ctggtgagaggcagcactaaggaccgaggcgcacaggttagacagtcgacccaaagttacgtggctctgggccggggcaagggtacagggaaggcctgtgcccatggagcactgccatgatcacattcctctgaggcctgcgtctttccacaggttcccatagctacagaggtgcttttcaaacttacacaggtaagtggaggtatctcagcccctcactggtctggaatgtccctccaccctccccagacagatattttctttagatttgtggtgtcatg

SEQ ID NO: 442343 - DNA, 2432 bp, Homo sapiens
tttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcgggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctaattta

SEQ ID NO: 442344 - DNA, 2748 bp, Homo sapiens
tttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggctgttcagtggaagaaaagactttagagatggatgaggacgttgaggcagagggaggttgaatatttttccaaggccacacaactggtgagaggcagcactaaggaccgaggcgcacaggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcagggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctaattta

SEQ ID NO: 442345 - DNA, 1470 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442346 - DNA, 1277 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgcc

SEQ ID NO: 442347 - DNA, 520 bp, Homo sapiens
ggatcgggatacgtgatgaagatgactctaggagaaacgatgcttcgtgatgatctacaatgatcttgagcttttttaatccggcacgacgcaagacgactggccgtcgtttgatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgaggggaagatcccaggcagccagaggaaacgaaaaagagaaagatggaactacagactctgggatcaaactagaacctgttccaggattgccaggagctcttcctcc

SEQ ID NO: 442348 - DNA, 661 bp, Homo sapiens
agaggaccccgcatctgcgtcccatcagtgaggaaggatgtagagagtatactctaatgactgggtctcttgcatggtcacctaaaatagaagtgggaaccatcactaagacagataaagaagagtagtaaccatggatgtgtgggggtaggatgaaacgggtgtccagctgttggcacagtctttaaatggggaatgttaagagattcattcagaggcaaagcagtaatggaggtcaaataacaccaaggtcaggactggtgcttttcctcccttttgctggctcagacttttgttggtaactcttggtagggcctaagtagtttcagacggtgtgacagattaggttaaaagcaaatgagattgactgggagagtcattcagcctgatgggagcaagatggcgcagtcttctcccatcagaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgggagcaagatggccagtcttctcccatcagcaattcctgaaacgggttaaaacttaactgg

SEQ ID NO: 442349 - DNA, 219 bp, Homo sapiens
aatttggttcctttaggaaaaaacaataataatggagatatttttgttttctttcatagtggttctatagatggtaataaccaacttgtaatcaaaggaagattccaacagaaacagatagaaaatgtcttgagaagatatatcagtaagtgtataattcatttcattagatcaccctgaaatgttctcatgaggctgcagtgttagaggaagagccat

SEQ ID NO: 442350 - DNA, 1887 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagggtgaggatctgagcccggcgtaagggctaaggattgaggcgagaagcctaacccactccagtgtgggagaacgggcctgcggcctagcagccggccgccgccatgtgaggcagccgcgcctaggcggcccggagcggcagagccggcgaggactccggagccgcaggcttggccgcagcccgctttcctcagggcggcagcgctgaggcggacctcctgccgtggttggcgtttccggaatggagagcacacgttgagtcgtcctcccggaaggggctcgaatgcccggttaataaccccgaacgagactggggctggcgatccctgcattcctttctgctgggcactgccgccccagctcgcctcactgggtgccgggggtgccaggggtgccgcgaggagcctctcttggcttgatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442351 - DNA, 1390 bp, Homo sapiens
actatctcatcaacaactgactaaacaccacccaacaatgactaatcaaactaacctcaaaacaaatgaagaccatacacaacactaaaggacgaacctgatctcttatactagtatccttaatcatttgcattgccacaactaacctcctcggactccggcctcacttcattagcaccaagccaccgaagagtctcaggccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442352 - DNA, 1247 bp, Homo sapiens
tttccctgccaaaataatgtcagcccacgtcatttttaaaaaagaacaggctgggtgtggtggctcatgcctgtaatcccagcattttgggaggccagggcgggaggatctcttgaggccaggagtttgagactagcctgagcaacaaagcaagacctcctcatctcaacagaaaatgtaataaaataaataaaaaagaatagtcccagtatcaaatgttcagactcatctcactttcttagggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442353 - DNA, 2922 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaatttggtttgtccttcagttttcttttctataaatgtgcttggtgaaatcagcaagaaaccaaccatataaaacagtgtgtgccgggctctgactgagaaactgaacaatggcaggcgcttcatctgggcagccatttttcttctctgcttctcttgagatacatagttaaagtagacacggcgagacttaggaggattgcctgttttcagtgtccagggaatgactccatagatttgaattcttttccgtatgtggggatggttgctactacctcaccgccaagtcctcccccagctgttaccacatgagggaatacaaggtgctaggtaccctccttcctcgttggccactaagaggtcttagaaacatagcctgtaaatgtgtcttgtaactggcacactaaaaaagatcctagttgagcatctctcttggtgaggaagcgatgtgtgtgcggttcaggaaactcctccaagaggaggaggagtccaaacagggatgccagaggaagctttccgttttcctagccaacttgtgttctgggtttgaaaaagacccaccacaaatgctttttctattttctgatttaaaagtcgcttttgaatatgaccatgagaaaccaagaaatgctgcttgtgtggtgctctgcttcctgaggatttggctggaaggggattctccgctggcacatgggagaaggccatcttctgtgtcggtgctgtgatctgccttgttctcacttgctgaggataagggcatacacgctgctcctcgctttcttgttgcccgacttcgtactaagcagctcaggagcagtcactcagacccaaatgtcttgactgtgttgtttttaatcactgtgacccttaaagtacaggccaagtgttgtcaaacaccttggctaaaacagtggagggtgatgggtaaagcagtagagggccctcaacccacacactggctgaaactgccaccaactgccacgatgaacccaactgctgtttatgcccccattttcctttttttgtatctacacccacacgattcccaatgttggatatttctacatgaataaagcaaggatcagtgcctcttatgtaaaaaaaaaaacaaaaaaaaaaaaaaaaaaaaaaaacaaaaaaaacaaaaacaaagaaaaaaaaaaaaaaaaaaaaaaaaaaaaaaaagaggggggggcggcgcgccaaaataaaacccgcccggggcgcgccaacattgtcagtatcaccgccaacgtatttgttgtgtgcaaagaacggcgtgcccccacataaggaggagcagtatattataaaaagaggcaaggcgcgcgacggcatatatataaaaaaaaccgcgtcagaaggcaaaaacacgcggtgctgcagtgcaccttctgggagagacaacacccaacatggcggggaggaagcacaactcaggtggagacccccttg

SEQ ID NO: 442354 - DNA, 1089 bp, Homo sapiens
tcgcgttagtccgtaccagatcataatcttgacacatctgatatccagttcttggaggatgctggaaacaacgtggaggtagatgagtctttgttccaagaaatggatgacttggagctagaaaatgatgaaactgtccagactaccctcaagtttacatacagtgaaaaatacccagatgaagctcccctttatgaaatattctcccaggaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442355 - DNA, 1043 bp, Homo sapiens
  misc_feature (1)..(1): n is a, c, g, or t
nctttcacaattgaaacatatagtggaaatatgaagagtacatttaggccggggacgtggttcatgcatgtatcctagcactttgggaggctgagctattgtttgtattttctcattttttcgtatgtttatacgaaaatagggaatacatgaaattttttaaatgtaaaaagccctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442356 - DNA, 1604 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaaaaaaaaaaaaacaaaaaaaaaggggggggaaaatatccggggcccaattggcacacttttggaaagggccaaaggggggttaaaaaggaggggggtaaagggggaaaggggtttgggaccctgggggagggcgc

SEQ ID NO: 442357 - DNA, 1014 bp, Homo sapiens
  misc_feature (933)..(933): n is a, c, g, or t
  misc_feature (955)..(955): n is a, c, g, or t
  misc_feature (1014)..(1014): n is a, c, g, or t
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagctatagatggtataaccaacttgnatcaaggaagattcacagaacngatgaaatgcttggaaattacaggattgccttgccctccgtacgcacatctgagaagcn

SEQ ID NO: 442358 - DNA, 503 bp, Homo sapiens
gtaattctgtgtgttgctttatttgcagaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442359 - DNA, 1229 bp, Homo sapiens
ggcacgagggaagaggacactaggaaaaaagatgcttcgccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442360 - DNA, 697 bp, Homo sapiens
ttttcttggttcctactcggacgacttgtggaggtttcatgacaacttcttttgtcaacttgacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442361 - DNA, 1532 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagctgacccgtctgacttcccgtccgtgccgagcccactcgagccgcagccatgtctggggacgatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442362 - DNA, 1493 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggtagtattgctttcttgttgaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442363 - DNA, 1049 bp, Homo sapiens
ctgaagaaggtgtaaaggatcttaagattgaaagtgatgttcaaggtcatcctctggttcagttggttcttgaacatcactttcaatcttaagatccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442364 - DNA, 2948 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaatttggtttgtccttcagttttcttttctataaatgtgcttggtgaaatcagcaagaaaccaaccatataaaacagtgtgtgccgggctctgactgagaaactgaacaatggcaggcgcttcatctgggcagccatttttcttctctgcttctcttgagatacatagttaaagtagacacggcctcccacgcgagtgtggtgggaccttgagacttaggaggattgcctgttttcagtgtccagggaatgactccatagatttgaattcttttccgtatgtggggatggttgctactacctcaccgccaagtcctcccccagctgttaccacatgagggaatacaaggtgctaggtaccctccttcctcgttggccactaagaggtcttagaaacatagcctgtaaatgtgtcttgtaactggcacactaaaaaagatcctagttgagcatctctcttggtgaggaagcgatgtgtgtgcggttcaggaaactcctccaagaggaggaggagtccaaacagggatgccagaggaagctttccgttttcctagccaacttgtgttctgggtttgaaaaagacccaccacaaatgctttttctattttctgatttaaaagtcgcttttgaatatgaccatgagaaaccaagaaatgctgcttgtgtggtgctctgcttcctgaggatttggctggaaggggattctccgctggcacatgggagaaggccatcttctgtgtcggtgctgtgatctgccttgttctcacttgctgaggataagggcatacacgctgctcctcgctttcttgttgcccgacttcgtactaagcagctcaggagcagtcactcagacccaaatgtcttgactgtgttgtttttaatcactgtgacccttaaagtacaggccaagtgttgtcaaacaccttggctaaaacagtggagggtgatgggtaaagcagtagagggccctcaacccacacactggctgaaactgccaccaactgccacgatgaacccaactgctgtttatgcccccattttcctttttttgtatctacacccacacgattcccaatgttggatatttctacatgaataaagcaaggatcagtgcctcttatgtaaaaaaaaaaacaaaaaaaaaaaaaaaaaaaaaaaacaaaaaaaacaaaaacaaagaaaaaaaaaaaaaaaaaaaaaaaaaaaaaaaagaggggggggcggcgcgccaaaataaaacccgcccggggcgcgccaacattgtcagtatcaccgccaacgtatttgttgtgtgcaaagaacggcgtgcccccacataaggaggagcagtatattataaaaagaggcaaggcgcgcgacggcatatatataaaaaaaaccgcgtcagaaggcaaaaacacgcggtgctgcagtgcaccttctgggagagacaacacccaacatggcggggaggaagcacaactcaggtggagacccccttg

SEQ ID NO: 442365 - DNA, 1413 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaacttggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaa

SEQ ID NO: 442366 - DNA, 1322 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagtggttctatagatggtaataaccaacttgtaatcaaaggaagattccaacagaaacagatagaaaatgtcttgagaagatatatcaaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctttttagggaaaaatattacacagagatggttatgacagctagtatcgtaatagtgtcagtaccacgtggtaacaacattgtaacgtgcctgttccacgcgccgttcgtactatataacacggtacggactgattgtatatgtacc

SEQ ID NO: 442367 - DNA, 1043 bp, Homo sapiens
aggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaagatgcttctgatgatctagatgacttgaacttctttaatcaaaagaaaaagaagaaaaaaactaaaaagatatttgatattgatgaagctgaagaaggtgtaaaggatcttaagattgaaagtgatgttcaagaaccaactgaaccagaggatgaccttgacattatgcttggcaataaaaagaagaaaaagaagaatgttaagttcccagatgaggatgaaatactagagaaagatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcagcccaaacatctccttgcatttttgttggctgaattgggtacaagctttattgagataacagcttacaaatttaaagtgtataatccaggagagtcccactcggacgtccgtctctctcgcaagacagagctattctttctcttttgcctattaaacctccacccttggaccccccccc

SEQ ID NO: 442368 - DNA, 1664 bp, Homo sapiens
ctcaggtccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagtaggta

SEQ ID NO: 442369 - DNA, 2425 bp, Homo sapiens
ctcaggtccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcagtcatttgatctccatctcatctctaattattataaagaattaaaacaagtcatcattgtagaaaagcaagaaaatgcagatagagaaaaagaagaaaataaaactggagtatttccacaacccaagtttagagttggcccccacctcccatgccatggactgagcagcaggggcccagcatcccttggatatggtggctgtgtcttcatgtgaaagaaactgaacttggtggtttttcctgccagttcaggagagattcttggcatgtaatatatatcactgctcaagtcaagcctcctaaaaccacagacctgtttcagctgctacttcagccaaaattcttcagcttcatattgtcttgaaaacctatgattgtctctaacaaacaggctacttgctagttagaaattcttatcaatttggcaagctacttatcaaccagactgaccacaagaactgtcatctcatcaatgaaggagtaactgatcaatgaagccagcaatgcttttttcttggcatcatcaaagctgacatttagaagagatgctggtgatagtcatctcatcctactcaatttttcaaaggcagaaaccaaccctggagcaattgagaggactgtttaaacacagagcttaacaatggcagaattgtatatctcgtgcttaacagattttggttgaactttaccctaggtcaggggtcagcaaactactgcctgtgggccaaatttgcccaccacctgtatctgtaaataaggtttcattggaacacagctgtggccatatgtttgtatattgtgtgtggctgcttttgcattaggatgacagaggtgaatagttgcaacagagactggctggtctgcaaagcctaaaatatgtcctgtgtggccctttacagaaaaagttttctaacccctgctctaggttacggagaaaaaaaaaatggaataatgttctctgctacttttaacctgattttctttgttacctaaataggcagctagaatgctgcctatattttaataaggatttggatctcacaagacaccttaggccttacacaagttgttcagattctttgccccagttctaatctagtgacaaaggcatagaattctcctcccacaggaatgtatttctattttcaaggtgttaattagttccagttttggttttgtcgttttccccatgtccgatgcttatattggatgatttctgataaaccctgactattccaataaaccctaggcatttttgaatttaaac

SEQ ID NO: 442370 - DNA, 925 bp, Homo sapiens
agtttctatgattaagatcaaaatttaagcaaggctgccacgttccttcctagataggtgtggattgcatttattcaggtaacagtttctcctaataattgtgttaaagtgaaatcagaagaccttggttagcatcattcattactttattctaaaattattgaactcaagtatgacacataaagtttctgtgaacttttcatgttaaaactaatgtcagttattgaagggttaggatttgatattcaaaaatttataggaagcccttcagaatgtaagttctgtgaaggtgcggatttttttaattcaatttttattgagatctaatatacataaagtaaaagtcaccagttttaagtgtacaatttaatgagttttaacaaatggacatagttgtatagccagcaccataatcacaatatggaacaattctgtccctccagaacattccttcatggccctttgcagtccgtgctctcccatcccactggctcaggaaatccctagctttggaagacaaggaattgtttgattgtttgagatggaggtttgctcttgttgcccaggctggagtacaatggcgtgatctcggctcactgcaacctctgcctcccagattctcctgcctcagcctcccgagtagctgggattacaggcatgcaccgccacacccggctaatttttgtatttttcagtagagacagggtttcaccatgttggccaggctggtctcaaactcctgacctcaggtgatccacccatcttggcctcccaaagtgctgggattacaggcatgagccaccgcgcccggcctctgtttgttttattcgttgcattgtctccagtttccagaactctggcacattataggtgcttaatggattttcgttggctgaacgaaagcagtcataaataaatactgcaa

SEQ ID NO: 442371 - DNA, 1798 bp, Homo sapiens
ctcaggtccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccgggatgaggtttcgccatgttggccaggctggtctcgagctcttgacctcagatgatccacccgcctcagcctcccaacatgctgggattacaggcgtgaaccactgcacccggctggattagagtgtttttaaggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagtaggta

SEQ ID NO: 442372 - DNA, 1795 bp, Homo sapiens
ctcaggtccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggtcatgcccttccctaaccccaggacaggactggagtttgttattttttccttccccctctcctcttttccttcctccctcccttgcttctttccttcccgccttctctcctccctccatttcttcctttccttcaaatgtatgttgagaggtctttgtggtatcctatagaaaaactgagaaacaatgaataagaatttgtattaaaataggaaaccatgcatgtcttgggcatctcaaagcctcctcccccagccccaccaaaaacaaagaaaagaacatgctattggttttttaaataatacatgcttatgattaaatttaattgagaacatgcaaaaattatcacattataaagaggaaattagaaatcgcccatagttctgctatccagaaatagttaccgttagcagtttagtatgttttcttctagacccaggagtgagcaaacagcagcctttgggccacattgggcctgctacctgtttttggaaataaagttttattggaactcagccacactcattcttccacacactgtctatgactactttcaaactacaagtggcagagttgagtacttgtgacagagattgaatggcctgcaaagcctgaaaaatttactgtatggtcattttcagaataagtttgcccacctctggtctaaaccttttcttatgcagatgtacacgtattaattaaaattcaaaactgagttcatgacatatgttctgttttgaaactact

SEQ ID NO: 442373 - DNA, 1019 bp, Homo sapiens
gtgggagactgtattcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaatgctccagaacctggaactcaagatgccagcatcccagttgagaaacttccccggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagtaggta

SEQ ID NO: 442374 - DNA, 962 bp, Homo sapiens
ctcaggtccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtaggtagaaaactctgatttgtactggtgttccaggttacc

SEQ ID NO: 442375 - DNA, 1034 bp, Homo sapiens
ctcaggtccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccagaacattccttcatggccctttgcagtccgtgctctcccatcccactggctcaggaaatccctagctttggaagacaaggaattgtttgattgtttgagatggaggtttgctcttgttgcccaggctggagtacaatggcgtgatctcggctcactgcaacctctgcctcccagattctcctgcctcagcctcccgagtagctgggattacaggcatgcaccgccacacccggctaatttttgtatttttcagtagagacagggtttcaccatgttggccaggctggtctcaaactcctgacctcaggtgatccacccatcttggcctcccaaagtgctgggattacaggcatgagccaccgcgcccggcctctgtttgttttattcgttgcattgtctccagtttccagaactctggcacattataggtgcttaatggattttcgttggctgaacgaaagcagtcataaataaatactgcaa

SEQ ID NO: 442376 - DNA, 398 bp, Homo sapiens
tcataagcaaggcaagtttatataggctgggagggagggtgtagggaataagaggcatcagaggtgacccatctggatgtactaggtttggggcagcccctggcctccctccgatccagctgggcagacttggctcggggttggcttaaggatcccattcttccaggtgtgaagaggcaggctgcgggggcttgctgcgacctcacgtcgtgtggtttggagaaaacctggatcctgccattctggaggaggttgacagagagctcgcccactgtgatttatgtctagtggtgggtcatgcccttccctaaccccaggacaggactggagtttgttattttttccttccccctctcctcttttccttcctccctcccttgcttctttccttcccgcct

SEQ ID NO: 442377 - DNA, 268 bp, Homo sapiens
acacaaacggaaaacagccagttcagaggatgatctgttactaaagattttttaaaggacattcgtgtatgtgtgcgtgtgggtataatataatatacatgatgcgtttctgtaatatataaaatataaatatttatacatatttccatatataaaaatatttgctgattgtttctacactatttgtttttgtgatttttctaaagcccgcctcaagcattagaactacagacaaaccctgatgcgacctctccagattgtcccaagt

SEQ ID NO: 442378 - DNA, 231 bp, Homo sapiens
acaaatgtccaaactgtacactggattgataaagatttcactctgtttaggtatggcagattttcgaaagttttttgcaaaagcaaagcacatagtcatcatctcaggagctggtgttagtgcagaaagtggtgttccgaccttcagaggagctggaggttattggagaaaatggcaagcccaggtttgtaaagtttccagaacattaaaagcctctgtcgaatgaaacca

SEQ ID NO: 442379 - DNA, 1916 bp, Homo sapiens
ctcaggtccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaaaaaaaaaaaaaaaaaaaaaaaaaaaaggaaaaaaaaaaagaacacggagaagaagagcaccaacaagaaggggacaaaagtggagcagaagggacatacggagagtgacgcccgatataatagccaggagcaaaaagctgaggaaaagacgcccgcgcatctagcagcgaccacgcgaagcgcgacgacggacgaccacaggagagcaccacctaaacgaccagcgcagataacagcgaagaacacaccagcaggcgagaaagacgctaacacgtcacccaaacagaacaactgaaaacacgggacacgaaccggccaacacgcagcggcaacaaggaccgcagacgaagcacacgcgcacagagccacagt

SEQ ID NO: 442380 - DNA, 1457 bp, Homo sapiens
gtgggagactgtattcgggggcgcgagctgccccagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccggtgtgaagaggcaggctgcgggggcttgctgcgacctcacgtcgtgtggtttggagaaaacctggatcctgccattctggaggaggttgacagagagctcgcccactgtgatttatgtctagtggtgggcacttcctctgtggtgtacccagcagccatgtttgccccccaggtggctgccaggggcgtgccagtggctgaatttaacacggagaccaccccagctacgaacagattcaggtttcatttccagggaccctgtggaacgactcttcctgaagcccttgcctgtcatgaaaatgaaactgtttcttaagtgtcctggggaagaaagaaattacagtatatctaagaactaggccacacgcagaggagaaatggtcttatgggtggtgagctgagtactgaacaatctaaaaatagcctctgattccctcgctggaatccaacctgttgataagtgatgggggtttagaagtagcaaagagcacccacattcaaaagtcacagaactggaaagttaattcatattatttggtttgaactgaaacgtgaggtatctttgatgtgtatggttggttattgggagggaaaaattttgtaaattagattgtctaaaaaaaatagttattctgattatatttttgttatctgggcaaagtagaagtcaaggggtaaaaaccctactattctgatttttgcacaagttttagtggaaaataaaatcacactctacagtaggta

SEQ ID NO: 442381 - DNA, 1929 bp, Homo sapiens
ctcaggtccggagcgcggtcgggacacagcgcctctaggagaaagcctggaaggcgctccgggggtacccagagctcttagcgggccggcagcatgtgcggggcccaagtaaatggaaatgttttctaacatataaaaacctacagaagaagaaaataattttctggatcaaattagaagtctgtattatattgatgtctccagattcaaatatattagaaagcagccgtggagacaaccatcttcattttgggagaaataactaaagcccgcctcaagcattagaactacagacaaaccctgatgcgacctctccagattgtcccaagtcgattgatttcccagctatattgtggcctgaagcctccagcgtccacacgaaaccagatttgcctgaaaatggctcggccaagttcaagtatggcagattttcgaaagttttttgcaaaagcaaagcacatagtcatcatctcaggagctggtgttagtgcagaaagtggtgttccgaccttcagaggagctggaggttattggagaaaatggcaagcccaggacctggcgactcccctggcctttgcccacaacccgtcccgggtgtgggagttctaccactaccggcgggaggtcatggggagcaaggagcccaacgccgggcaccgcgccatagccgagtgtgagacccggctgggcaagcagggccggcgagtcgtggtcatcacccagaacatcgatgagctgcaccgcaaggctggcaccaagaaccttctggagatccatggtagcttatttaaaactcgatgtacctcttgtggagttgtggctgagaattacaagagtccaatttgtccagctttatcaggaaaaggtgctccagaacctggaactcaagatgccagcatcccagttgagaaacttccccgggatgaggtttcgccatgttggccaggctggtctcgagctcttgacctcagatgatccacccgcctcagcctcccaacatgctgggattacaggcgtgaaccactgcacccggctggattagagtgtttttaaggtgtgaagaggcaggctgcgggggcttgctgcgacctcacgtcgtgtggtttggagaaaacctggatcctgccattctggaggaggttgacagagagctcgcccactgtgatttatgtctagtggtgggtcatgcccttccctaaccccaggacaggactggagtttgttattttttccttccccctctcctcttttccttcctccctcccttgcttctttccttcccgccttctctcctccctccatttcttcctttccttcaaatgtatgttgagaggtctttgtggtatcctatagaaaaactgagaaacaatgaataagaatttgtattaaaataggaaaccatgcatgtcttgggcatctcaaagcctcctcccccagccccaccaaaaacaaagaaaagaacatgctattggttttttaaataatacatgcttatgattaaatttaattgagaacatgcaaaaattatcacattataaagaggaaattagaaatcgcccatagttctgctatccagaaatagttaccgttagcagtttagtatgttttcttctagacccaggagtgagcaaacagcagcctttgggccacattgggcctgctacctgtttttggaaataaagttttattggaactcagccacactcattcttccacacactgtctatgactactttcaaactacaagtggcagagttgagtacttgtgacagagattgaatggcctgcaaagcctgaaaaatttactgtatggtcattttcagaataagtttgcccacctctggtctaaaccttttcttatgcagatgtacacgtattaattaaaattcaaaactgagttcatgacatatgttctgttttgaaactact

SEQ ID NO: 442382 - DNA, 1882 bp, Homo sapiens
tatttttcttttgtccccctatgtttcccctccctctatgttttgtggttccttgctcacaatgttctccatgtgtctacgtgttgtccccgctgtcgcgggcgtgtgtttatttcgtccgcgcgcattgctttgccggttttctacgtcccttctctcctcatagtggtctcctctgttctcacatactttttttgtgttccccctatctttggtgccccctcctgtgtgtgcttctttgtgtgtctccccccctttttttttttttcttttttttttttttttttttttttttttttcttaggagaatgttttaatgcttaagaggcaggatcaagtgaagaggttacagaaatcagtgtctctggctgggcagtcaagagagcgggctcaaattctgtgactcacttctctgtgtctcggttggaaatgaatgggtatcctggttcccaccttcccacacgctgtgatacttcaaactccttgggtgaagggcctcttctcagcccaagatcttgattgtgaacattaacaaagagaacagtcatcctccacagaagataactcattaatgacatttgattcagtgaataaatatatcatttaaaaaaatattgtagggggatcatgaaagtagtggaggtaattacaatcaggagagattggtattaaaattgagcaaagtcccaactctcaccagatgacaattatgcatcctgctagatgccccagggctgtcagcctggaactgaaataaatgtgttataagtggtgctggatgcctttttcagttcatttgaaaacatggatttgatcatgtcagctccctttctgctggaaaaaaaagtagtttgcataattggtgttaactactctgttttgattctacagagtaagtaatactcaaatgtggtcttactttaacttcttgcctttgttacccccagaaccatgcagacattgaaatgtggtgtgcgtgtgtgtgtgtgtgtgtgtgtgtgtgtgtgttcatataacaggaggacaggaaaggtaaggacccagaacaatgaagacttattgaaatgtggtatgtgtgtgcgtgtgtgtgtgtgtgtgtgtgtgtgtgtgtgtgtgtgttcatataacaggaggacaggaaaggtaatgaccatccatggaagatgaaggggtagtacttagcaccagaatcttttccagtttttacccatctttcattactccttgtctccaaatcatcccttccttaataacttaaaataacttaaaatattttctgaggacttgatgacaccagtcagaagtccaagagtggtctggtataagggagtgttcatcaaggggcagctggaaaaagtggaattggcacaggcaacatctttcttttcagatgtttgaggtcacccagaggagataacagtctgtcaacatagagccctcaaagttaaaaagcagtagccaggcaagacttgtgtcttttcagggctcttccaggctctaagagtgtgaaattcagacaggtttttaaaaatcaaaataaaaggagagtagttcttacaggcagaaactcttagagctcacaaattggaaacaactgcaaacttcagagtaaattcatagcttccaaatacaaatgttcacattgtccctccgctatttttacacaaatgcattcaggtgaagacagcaacacacattgggaaaggacatctgcttcctattttagtcccagaatcacttttgcttctagtcccaactgttccctctccccaatcccaaccttatccatgtaacagtatgaatttcctggcccagagacctaaacaagaagtcacgaatatacctacttttggttgcacttgccatttcaatgcttaggaaa

SEQ ID NO: 442383 - DNA, 7927 bp, Homo sapiens
caaggcgggggcctgtttgcagagagccgggcatttgcatgaagcgactcgaccccacggagcagcggcagcagcagcggaccccggcggcggcggcggcgcgcggtcccagccaggcggccccggtgtcccggccccggtggatgcacggctggggaggagcccatgggccggagctgaggctgcccggggcggcggggcgcggggcagggggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaattgttactcttgttggccttctgctgtttgtagattagtgcacctatctgtgagggatttgggttacctccctgagtctgtaagcaaccacaagccctgccactgggtgggggaagtccctccccaaccacttaaaaacaaattttccacatattacccacccacacatttgacctggctagactctttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagccagctttgtcacccaaatctgtgtctatttctgatagtccatggaatgtggttttcttggaagccagggttggtctccccacagaccccaggctaaggtcaccagttaggaacccaggacttggaaggcagagcctgtgagctcttccatcagggatctgactccgcaaaacgacttgatgaatgcaattggcaaactcccatgttcggacttcatatgcatgagccgttggacagagggtttcttagtatatactttaatgcatgtttatgtgcaatcttgttagtgggtatacaagtttgtgaagaacttctcatttcaataggcagttaatgtaatgcattaaaagcctgggaatttggggctatatttttcctttctgactcaataatcttcaaagaattcataggaaagtcagtacttgcagacaagtggttagcttggctaaaatgtacaaaacacccagaacccacaaaacactcagaggtttaggagaatgttttaatgcttaagaggcaggatcaagtgaagaggttacagaaatcagtgtctctggctgggcagtcaagagagcgggctcaaattctgtgactcacttctctgtgtctcggttggaaatgaatgggtatcctggttcccaccttcccacacgctgtgatacttcaaactccttgggtgaagggcctcttctcagcccaagatcttgattgtgaacattaacaaagagaacagtcatcctccacagaagataactcattaatgacatttgattcagtgaataaatatatcatttaaaaaaatattgtagggggatcatgaaagtagtggaggtaattacaatcaggagagattggtattaaaattgagcaaagtcccaactctcaccagatgacaattatgcatcctgctagatgccccagggctgtcagcctggaactgaaataaatgtgttataagtggtgctggatgcctttttcagttcatttgaaaacatggatttgatcatgtcagctccctttctgctggaaaaaaaagtagtttgcataattggtgttaactactctgttttgattctacagagtaagtaatactcaaatgtggtcttactttaacttcttgcctttgttacccccagaaccatgcagacattgaaatgtggtgtgcgtgtgtgtgtgtgtgtgtgtgtgtgtgtgtgttcatataacaggaggacaggaaaggtaaggacccagaacaatgaagacttattgaaatgtggtatgtgtgtgcgtgtgtgtgtgtgtgtgtgtgtgtgtgtgtgtgtgtgttcatataacaggaggacaggaaaggtaatgaccatccatggaagatgaaggggtagtacttagcaccagaatcttttccagtttttacccatctttcattactccttgtctccaaatcatcccttccttaataacttaaaataacttaaaatattttctgaggacttgatgacaccagtcagaagtccaagagtggtctggtataagggagtgttcatcaaggggcagctggaaaaagtggaattggcacaggcaacatctttcttttcagatgtttgaggtcacccagaggagataacagtctgtcaacatagagccctcaaagttaaaaagcagtagccaggcaagacttgtgtcttttcagggctcttccaggctctaagagtgtgaaattcagacaggtttttaaaaatcaaaataaaaggagagtagttcttacaggcagaaactcttagagctcacaaattggaaacaactgcaaacttcagagtaaattcatagcttccaaatacaaatgttcacattgtccctccgctatttttacacaaatgcattcaggtgaagacagcaacacacattgggaaaggacatctgcttcctattttagtcccagaatcacttttgcttctagtcccaactgttccctctccccaatcccaaccttatccatgtaacagtatgaatttcctggcccagagacctaaacaagaagtcacgaatatacctacttttggttgcacttgccatttcaatgcttaggaaa

SEQ ID NO: 442384 - DNA, 5444 bp, Homo sapiens
caaggcgggggcctgtttgcagagagccgggcatttgcatgaagcgactcgaccccacggagcagcggcagcagcagcggaccccggcggcggcggcggcgcgcggtcccagccaggcggccccggtgtcccggccccggtggatgcacggctggggaggagcccatgggccggagctgaggctgcccggggcggcggggcgcggggcagggggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaa

SEQ ID NO: 442385 - DNA, 3730 bp, Homo sapiens
acattaccctaggaaggacactaggctagaaggatgcaattggggaccagaactagttccttgggtccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaa

SEQ ID NO: 442386 - DNA, 3160 bp, Homo sapiens
ggatgttatcgtagctgaaggggaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaattgttactcttgttggccttctgctgtttgtagattagtgcacctatctgtgagggatttgggttacctccctgagtctgtaagcaaccacaagccctgccactgggtgggggaagtccctccccaaccacttaaaaacaaattttccacatattacccacccacacatttgacctggctagactctttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagccagctttgtcacccaaatctgtgtctatttctgatagtccatggaatgtggttttcttggaagccagggttggtctccccacagaccccaggctaaggtcaccagttaggaacccaggacttggaaggcagagcctgtgagctcttccatcagggatctgactccgcaaaacgacttgatgaatgcaattggcaaactcccatgttcggacttcatatgcatgagccgttggacagagggtttcttagtatatactttaatgcatgtttatgtgcaatcttgttagtgggtatacaagtttgtgaagaacttctcatttcaataggcagttaatgtaatgcattaaaagcctgggaatttggggctatatttttcctttctgactcaataatcttcaaagaattcataggaaagtcagtacttgcagacaagtggttagcttggctaaaatgtacaaaacacccagaacccacaaaacactcagaggtttaggagaatgttttaatgcttaagaggcaggatcaagtgaagaggttacagaaatcagtgtctctggctgggcagtcaagagagcgggctcaaattctgtgactcacttctctgtgtctcggttggaaatgaatgggtatcctggttcccaccttcccacacgctgtgatacttcaaactccttgggtgaagggcctcttctcagcccaagatcttgattgtgaacattaacaaagagaacagtcatcctccacagaagataactcattaatgacatttgattcagtgaataaatatatcatttaaaaaaatattgtagggggatcatgaaagtagtggaggtaattacaatcaggagagattggtattaaaattgagcaaagtcccaactctcaccagatgacaattatgcatcctgctagatgccccagggctgtcagcctggaactgaaataaatgtgttataagtggtgctggatgcctttttcagttcatttgaaaacatggatttgatcatgtcagctccctttctgctggaaaaaaaagtagtttgcataattggtgttaactactctgttttgattctacagagtaagtaatactcaaatgtggtcttactttaacttcttgcctttgttacccccagaaccatgcagacattgaaatgtggtgtgcgtgtgtgtgtgtgtgtgtgtgtgtgtgtgtgttcatataacaggaggacaggaaaggtaaggacccagaacaatgaagacttattgaaatgtggtatgtgtgtgcgtgtgtgtgtgtgtgtgtgtgtgtgtgtgtgtgtgtgttcatataacaggaggacaggaaaggtaatgaccatccatggaagatgaaggggtagtacttagcaccagaatcttttccagtttttacccatctttcattactccttgtctccaaatcatcccttccttaataacttaaaataacttaaaatattttctgaggacttgatgacaccagtcagaagtccaagagtggtctggtataagggagtgttcatcaaggggcagctggaaaaagtggaattggcacaggcaacatctttcttttcagatgtttgaggtcacccagaggagataacagtctgtcaacatagagccctcaaagttaaaaagcagtagccaggcaagacttgtgtcttttcagggctcttccaggctctaagagtgtgaaattcagacaggtttttaaaaatcaaaataaaaggagagtagttcttacaggcagaaactcttagagctcacaaattggaaacaactgcaaacttcagagtaaattcatagcttccaaatacaaatgttcacattgtccctccgctatttttacacaaatgcattcaggtgaagacagcaacacacattgggaaaggacatctgcttcctattttagtcccagaatcacttttgcttctagtcccaactgttccctctccccaatcccaaccttatccatgtaacagtatgaatttcctggcccagagacctaaacaagaagtcacgaatatacctacttttggttgcacttgccatttcaatgcttaggaaa

SEQ ID NO: 442387 - DNA, 4891 bp, Homo sapiens
caaggcgggggcctgtttgcagagagccgggcatttgcatgaagcgactcgaccccacggagcagcggcagcagcagcggaccccggcggcggcggcggcgcgcggtcccagccaggcggccccggtgtcccggccccggtggatgcacggctggggaggagcccatgggccggagctgaggctgcccggggcggcggggcgcggggcagggggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccctctgcgccccctgtgctggtcagcacagaggaggcacagaggagtgatgaagcggatcccaatacggcagaagacagaaaatggggcatcggcgtgagcgccctggctacaggctggggttgggaggcctctctgggcctggaggtgggggtgggggcagccaagtccagccactcttcacctggctccctcctctgtgctgtcagcacagaggagggggggaagtatgtaggagttgaagattagtcc

SEQ ID NO: 442388 - DNA, 6876 bp, Homo sapiens
caaggcgggggcctgtttgcagagagccgggcatttgcatgaagcgactcgaccccacggagcagcggcagcagcagcggaccccggcggcggcggcggcgcgcggtcccagccaggcggccccggtgtcccggccccggtggatgcacggctggggaggagcccatgggccggagctgaggctgcccggggcggcggggcgcggggcagggggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaattgttactcttgttggccttctgctgtttgtagattagtgcacctatctgtgagggatttgggttacctccctgagtctgtaagcaaccacaagccctgccactgggtgggggaagtccctccccaaccacttaaaaacaaattttccacatattacccacccacacatttgacctggctagactctttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagccagctttgtcacccaaatctgtgtctatttctgatagtccatggaatgtggttttcttggaagccagggttggtctccccacagaccccaggctaaggtcaccagttaggaacccaggacttggaaggcagagcctgtgagctcttccatcagggatctgactccgcaaaacgacttgatgaatgcaattggcaaactcccatgttcggacttcatatgcatgagccgttggacagagggtttcttagtatatactttaatgcatgtttatgtgcaatcttgttagtgggtatacaagtttgtgaagaacttctcatttcaataggcagttaatgtaatgcattaaaagcctgggaatttggggctatatttttcctttctgactcaataatcttcaaagaattcataggaaagtcagtacttgcagacaagtggttagcttggctaaaatgtacaaaacacccagaacccacaaaacactcagaggtttaggagaatgttttaatgcttaagaggcaggatcaagtgaagaggttacagaaatcagtgtctctggctgggcagtcaagagagcgggctcaaattctgtgactcacttctctgtgtctcggttggaaatgaatgggtatcctggttcccaccttcccacacgctgtgatacttcaaactccttgggtgaagggcctcttctcagcccaagatcttgattgtgaacattaacaaagagaacagtcatcctccacagaagataactcattaatgacatttgattcagtgaacccaaagaacactttatgatgcattgtattgggatcagtgcagaagcaggtgaaaatacgaacaggaggggttgggggtaaaggtcaaggcaatggccaatgggccaagagcccctcattgatccctgtgacattcccaggggcagataggatgttatttattttggttggaaaaaaaaagaaggaacagcaacaactaggcaatgcattggcttgacccatataatgagtgatacccgt

SEQ ID NO: 442389 - DNA, 4070 bp, Homo sapiens
tactgagtggctgaataatgactccctgtgtaggctcctgccctagagagctggtcccctcctcagggacaggggcttctcttacatatccctcagcatggagcatgggaccagttgtggaatttacctcctattactttggagaaagcagaaatagcctaggtgactgggctgggagggaaaaactaagatctatcactcaccagggtgcattttgttcccctggcccttcatctctggtaccttttgggactgggtgggaaagttattaccaaaactgtttcccaatctggctcttctggccttggcccctcaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaa

SEQ ID NO: 442390 - DNA, 4868 bp, Homo sapiens
caaggcgggggcctgtttgcagagagccgggcatttgcatgaagcgactcgaccccacggagcagcggcagcagcagcggaccccggcggcggcggcggcgcgcggtcccagccaggcggccccggtgtcccggccccggtggatgcacggctggggaggagcccatgggccggagctgaggctgcccggggcggcggggcgcggggcagggggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggggttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaa

SEQ ID NO: 442391 - DNA, 308 bp, Homo sapiens
cccccgtcagcaagagtgaaataaaatccatcccaggggtttccaacacaagccgcaagaccaccaaaaaacaagccaagaaaggtaccagcctcttgtctcgtggggtactgagagtcaaagacttggctgtcagccctgagtctgcctcaacctccaagggtcatagccacggcttcaccctctgtgcctcaatttctgcatctgtaagtgggcctaaccagtaaatcttgacgattataccacagctgatgtgtatggatcagatggaaacaccttgagaaataaaaatatacaatgcaaaagta

SEQ ID NO: 442392 - DNA, 184 bp, Homo sapiens
ccaaggttgtgcagggacatcttattgactgcctccttctctgccatcctgtagaggaccgaagcagagggtgctgtttcaacgccaccaccaggagagaggcagaggggctgtgccgtgctagagtcctcagggagggagtgacctcgaccctggctgtgctgcaagctgactccagccttgg

SEQ ID NO: 442393 - DNA, 3266 bp, Homo sapiens
tggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggaccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaagaacaacctatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacactcccaaaaaactcacaaaacattttgctaaaaagatatgactgcttgaaatagtctctctcccatggagaaccacatttctctttctgccatacttgctactgctactgattttggaggaaatttttctagaagaacaaaggtcatatttgaggcaagctaaaaacttaattatacatggctactttactgtgtctgtagctaaagaaaaattattttacaaaaattacttcatgaaatatagtttgtaccccagtagttgagaaatgtgaccttttaggcaaagaacaggcagtccatctctcttagctttagtttatctctctgcctgaagacaggaaacaggcccaagtgcatactcgggttctttccaactcagaatcatctctgattccacaaaagtgagtttagtttcctatctgaattaacaactttaaaggagactataatagttaaaagtggaagaatagaaataaataaatttaaaatgaaattaattaaagtagaagagaagggttctgttccatgtacgattaatgtgccccttttggagataagctttccaaaatatgcgtatgagtaaaattagagaattccaccactaagcaacaatagattttatatgtgtgtgtggatatatatacacacacacacagaaagatgaatatatatatatatatatctgtataaatagacacacatataatatatatagatatataatccctatatatcttgaatctacaaatatctttatatgtatataatttgaatatatacatgtatgtatatacagatgtgtgtgtatatatatatatacatacacatatacataaattttcagctatttctgttcccctgaactaatttgagattagacccaaacatgcttttaaatgtctcatgccaaggcactgaattaagacttcttaatgttgaaatattttaagtgatttcatattaaattttctatatactgaaattgcttgtttgatttatcttaaagtcctattatatctttctacaaaccttcacgcaacttatctaaatgtcaaactaccaatcaaataatgt

SEQ ID NO: 442394 - DNA, 2994 bp, Homo sapiens
atgaagggtcacaggagatggctacactcccttctggaacattcagtgggactgtgctgtccgtggagtgctcagagctacatgcagttaatcacagaaggcttacagaggagatgggccaggccagagttattctgattttttagacactgtgatatgaagaagtagctgtgaattcctgggccaggtgttttcagtttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaagaacaacctatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacactcccaaaaaactcacaaaacattttgctaaaaagatatgactgcttgaaatagtctctctcccatggagaaccacatttctctttctgccatacttgctactgctactgattttggaggaaatttttctagaagaacaaaggtcatatttgaggcaagctaaaaacttaattatacatggctactttactgtgtctgtagctaaagaaaaattattttacaaaaattacttcatgaaatatagtttgtaccccagtagttgagaaatgtgaccttttaggcaaagaacaggcagtccatctctcttagctttagtttatctctctgcctgaagacaggaaacaggcccaagtgcatactcgggttctttccaactcagaatcatctctgattccacaaaagtgagtttagtttcctatctgaattaacaactttaaaggagactataatagttaaaagtggaagaatagaaataaataaatttaaaatgaaattaattaaagtagaagagaagggttctgttccatgtacgattaatgtgccccttttggagataagctttccaaaatatgcgtatgagtaaaattagagaattccaccactaagcaacaatagattttatatgtgtgtgtggatatatatacacacacacacagaaagatgaatatatatatatatatatctgtataaatagacacacatataatatatatagatatataatccctatatatcttgaatctacaaatatctttatatgtatataatttgaatatatacatgtatgtatatacagatgtgtgtgtatatatatatatacatacacatatacataaattttcagctatttctgttcccctgaactaatttgagattagacccaaacatgcttttaaatgtctcatgccaaggcactgaattaagacttcttaatgttgaaatattttaagtgatttcatattaaattttctatatactgaaattgcttgtttgatttatcttaaagtcctattatatctttctacaaaccttcacgcaacttatctaaatgtcaaactaccaatcaaataatgt

SEQ ID NO: 442395 - DNA, 3182 bp, Homo sapiens
tggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggaccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaagaacaacctatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacactcccaaaaaactcacaaaacattttgctaaaaagatatgactgcttgaaatagtctctctcccatggagaaccacatttctctttctgccatacttgctactgctactgattttggaggaaatttttctagaagaacaaaggtcatatttgaggcaagctaaaaacttaattatacatggctactttactgtgtctgtagctaaagaaaaattattttacaaaaattacttcatgaaatatagtttgtaccccagtagttgagaaatgtgaccttttaggcaaagaacaggcagtccatctctcttagctttagtttatctctctgcctgaagacaggaaacaggcccaagtgcatactcgggttctttccaactcagaatcatctctgattccacaaaagtgagtttagtttcctatctgaattaacaactttaaaggagactataatagttaaaagtggaagaatagaaataaataaatttaaaatgaaattaattaaagtagaagagaagggttctgttccatgtacgattaatgtgccccttttggagataagctttccaaaatatgcgtatgagtaaaattagagaattccaccactaagcaacaatagattttatatgtgtgtgtggatatatatacacacacacacagaaagatgaatatatatatatatatatctgtataaatagacacacatataatatatatagatatataatccctatatatcttgaatctacaaatatctttatatgtatataatttgaatatatacatgtatgtatatacagatgtgtgtgtatatatatatatacatacacatatacataaattttcagctatttctgttcccctgaactaatttgagattagacccaaacatgcttttaaatgtctcatgccaaggcactgaattaagacttcttaatgttgaaatattttaagtgatttcatattaaattttctatatactgaaattgcttgtttgatttatcttaaagtcctattatatctttctacaaaccttcacgcaacttatctaaatgtcaaactaccaatcaaataatgt

SEQ ID NO: 442396 - DNA, 1963 bp, Homo sapiens
tggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggaccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaagaacaacctatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgttt

SEQ ID NO: 442397 - DNA, 1000 bp, Homo sapiens
agtgacaactgcagccgcacgtgggctcggcgcgatggaggaggagatgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcacttta

SEQ ID NO: 442398 - DNA, 983 bp, Homo sapiens
  misc_feature (883)..(883): n is a, c, g, or t
agtgacaactgcagccgcacgtgggctcggcgcgatggaggaggagatgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtacaaggtcgggggggctgntgtgagcccagctggggcatcccagagtatcaggccttggggggtcaataatctaaaaaaaaccggttctgggaaaggaaaggggttgtccttgaagatg

SEQ ID NO: 442399 - DNA, 886 bp, Homo sapiens
agtgacaactgcagccgcacgtgggctcggcgcgatggaggaggagatgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcacttta

SEQ ID NO: 442400 - DNA, 852 bp, Homo sapiens
agtgacaactgcagccgcacgtgggctcggcgcgatggaggaggagatgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctgctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcacttta

SEQ ID NO: 442401 - DNA, 481 bp, Homo sapiens
agtgacaactgcagccgcacgtgggctcggcgcgatggaggaggagatgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctgcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcacttta

SEQ ID NO: 442402 - DNA, 230 bp, Homo sapiens
gtgagtgaggccctccctgctgtctcctcaggtgacacctctgtcctggcgggtgtgtacgggccggccgaggtgaaggtcagcaaagagattttcaacaaggccacactcgaagtgatcctgaggccgaagattgggctgcctgcctggtaattgggccctgctgaacctctgagtggtgcccagtttgtcaaaatcacccccccagctcctccctaccagctgccccg

SEQ ID NO: 442403 - DNA, 363 bp, Homo sapiens
gcggggagggactgctattttccccattttacaaatgagagaaatgaagtgagtgctcaaagaatcagtaccaacaaatggcgggggtgacgtggggagccctggccgtcaggctcagtgccacaaatggggccccaggagcagggaagctgtgagtgaggccctccctgctgtctcctcaggtgacacctctgtcctggcgggtgtgtacgggccggccgaggtgaaggtcagcaaagagattttcaacaaggccacactcgaagtgatcctgaggccgaagattgggctgcctgcctggtaattgggccctgctgaacctctgagtggtgcccagtttgtcaaaatcacccccccagctcc

SEQ ID NO: 442404 - DNA, 310 bp, Homo sapiens
tctgagatggggtctccctctgttgcccagattggtcttgagtttctggcctcaagcagtgccctgccttggcctcccaaagtggtgagattatggtcatgagccactgtgcctggccaaaggactggctgagattttatctgaggggaaggtcctaggtcccccaccgccttctaccccttgtccctaggaggcccgggcagtcctgacctttgccctggacagcgtggaacggaagctgctgatgtccagcaccaaggggctctactcagacactgaggtaccagcatggggatgaggggaaaagcca

SEQ ID NO: 442405 - DNA, 986 bp, Homo sapiens
tcaaggcgcttcagtgggctggcgttggattggcatttcgtggccggcggtttgaccatgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcacttta

SEQ ID NO: 442406 - DNA, 1066 bp, Homo sapiens
agtgacaactgcagccgcacgtgggctcggcgcgatggaggaggagatgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctgcaggggtcagtggatggcagtcaggccttgccttcttcccactggaatcttccatcatccctgcaggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcacttta

SEQ ID NO: 442407 - DNA, 942 bp, Homo sapiens
  misc_feature (942)..(942): n is a, c, g, or t
agtgacaactgcagccgcacgtgggctcggcgcgatggaggaggagatgcatactgacgccaaaatccgtgctgaaaatggaacagggtccagccctcggggtcctggctgcagcctccggcactttgcctgcgaacagaacctgctgtcgcggccagatggctctgcttccttcctgcaaggtgacacctctgtcctggcgggtgtgtacgggccggccgaggtgaaggtcagcaaagagattttcaacaaggccacactcgaagtgatcctgaggccgaagattgggctgcctggtgttgcagagaagagccgggagcggctgatcaggaacacgtgcgaggcggtggtgctgggcacgttgcacccccgcacctccatcaccgtggtgctgcaggttgtcagcgatgccggctctctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggaggcccgggcagtcctgacctttgccctggacagcgtggaacggaagctgctgatgtccagcaccaaggggctctactcagacactgagctccagcagtgcctggctgcggcccaggccgcttcgcaacacgtcttccgtttctaccgggaatcgctgcagaggcgttactccaagagctgaggcaagctggggcaaggggccgctcccattgcctccacccactcacccctaagctggaaagaggagatcctctcaaaaaaaaaatccaaattccggcttgggcacccttggtccccctggagcgagggggggacctgcccgaagagtcggccaacggcccgccccggtcgggccttcccaaaaaaaaaagggggttcggn

SEQ ID NO: 442408 - DNA, 1207 bp, Homo sapiens
tataaacagactctgtgcagtgatggctaagggctcagattctagactcatacaaatctggtttatgtccagccctgctacttagaagctatgtgaccttggtcacaggggtttagggaagtgctgaggcaaggaagggcatttccagcagaggagctcttctgagaagcagaattagtgagaggttggtggcctgggtacatttaaggtgtggtgggaccttgtctggcatcatctaataaggctaccaggagtattatgggtttgttctggagtagttttcaaacgtggcatttggagtgaaggcaggcagcattgggcctcagattcagagtttctctatggaaattagatcaaaacctacaagagtcccagggaaaggtagggaggggcaagtgggaaagctgggagccctggagtcaggttgttctggctttgaaccccagcaatcccgatgcatagttgagaataggtactttgagtctctgttttctcatcggaaaatgggttggtcatgtcagtattgcatactgtgaagaccagaaacgatttatgtcaggggctttgcacacacaaataaggcactcaacaaatgtgggttgttatgaacccacagtggatggggaaacacatctgcctttgtggaagatgagagcagaatccctcctgaccattgttaagccatcagccttgctccttcccttggtttgtcactgctggagggactactgccagtactgcagtggggaaaatgagctttcaaaggtacgtttcttttatagagtgtccggtaggaattccctggggacatttatctcatggaaataggagaaggactgactgggtatctcaaaaggtgactcttagtgactgagtctcttttctagaagaaaaggatgtttggattctcagcagccacatctgcttttgaactctgtgcggtttgtgccctggcctcttaccactcccaacactcccccttttattcaaacagaggacagttgtgtttgttgaccactctttcagggtgggaaaggaatgtaatgtatgcatagactgcccagaatttcctgttagacacccattccaaaccacggccctgggatgcattccagagattacggcccaattctcaaagagaagaaatggcgcattcatttaaatgtccctggccttcagaaagagttcctcctctccccagttaaaa

SEQ ID NO: 442409 - DNA, 437 bp, Homo sapiens
aaaataccatatttgggctgtaattgtatcaactcactaggatgacactggtcatcttccacggatgaagaactcattgacaattataaatggttttctttgcgtggttgcttagtaaatgcccttttttggtgcagtcttttaaagcgtgatgcagtgggagaaaacttaacccatgtagtccttgtggaggaaaagattaggaactattggtctacacagctgagtcctctcctggctgtccaagagaccctgacagagtgcagttgttttagattcagaagtctcagtgactctttggtggtcacccagttgccctgtgtcctttaacacagctctgttagtccctccttcccactctgacagaggggaaagtgccctccttggaagcctcagctgttctttaacggcaggcgccgtctctgtcacactgcaga

SEQ ID NO: 442410 - DNA, 2035 bp, Homo sapiens
  misc_feature (890)..(890): n is a, c, g, or t
  misc_feature (941)..(941): n is a, c, g, or t
gcgcggagctctgtgggcgggtggctgttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcggtaccgccccgccctgcgccgccgccgccaccactcctggcctggcctggcccggcccgacagtccctgactcccgctcggctccccgcagggacgactatgacaagaaggtgaagcaggcggccaaggagaaggtgaggaggcggcacacgcccgcgccgacgcggccccgcaagccagacctgcaggtgtacctgccgcgacaccgaggtgaggccgcccgccccgcctgcctccagcccgcgcgctcttcctgcaacgcactccccttctctatagggaaaaaccacttcttactcctaaggttcagctcatctcgtctctttccggaacctccacctcagcgctcccaaatctccgctgaatgattctcaccaagaactgggacgactcataagcccccagttaagcatcgctgtcagagtatcggggagccagcaagaagtttatctgccggtttgccccaccgtgctgtattttagtaaggtgctccgctacctagcaaagagaaagtctggcacagcgatgagcgaccagcacataattgcggaatgaacccagtaaatggcctttccccagcttctctgctacctagagatcacactggttaatatatgacggtcaatttttgttaagcattattactttttttaaaatgtttttattttatttttgagactaggtctctgtcgcccaggctggagtgcantggtgcgatctgggcttactgcagccttagcctcccgagtacctgggaccncaggcgtgtgccaccacaccggttaattttggtatttcttgtagagaaggggtttccccggctgggcgcggtggctctcgcctgtaatcccagcactttgggaggccgaggcgggcggatcacgaggtcaggagatcgagaccatcctggctaacatggtgaaaccccgtctctactaaaaatacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcaacacagcaagactcggtctcaaaaaaaaaaaaaaaaagagagagagagaaggggtttctccacgttgtccaggctgatctcgaactcctgagctcaggtgatctgcccgcatcggcctcccaaagtgctgggattataggtgtgtgccactacctttgttaggcattagtgaaagtgcttttagatcttacgtatattaattcattgagtctttatacaacctcataagaaagcttctgtctgtttcacagtcaggaaacaggcacagagaggttaaacaacttgcccaagatctcagctagtaaatggcagagcctggatttgaacccaggcagagctctatccacccttctgctttccagtactttttgctagacaaatgtgcattgtgtacctactgtgtgacaggattgtgctggcctcagagcagggatgcaaaggtaaataagtccttgattggcagcacaccaaatgcttacactggtccgggcgcggtgattcatgcctgtgatcctagcagtttgggaggccgaggtgggcggatcccttgaggccaggagttcgaaattaacctggacaacatggtgaaaccccatctctactaaaaatacaaaaattagccaggcatgatggcaggcggctgtaatcccagctacttgggaggctgaggaaggagaattgcttgaacctgggaggcagaggttgcggtgagccgagatttagccactgcactccagcctgggcaacagagcaagactccgtctcaaaaaaaaa

SEQ ID NO: 442411 - DNA, 841 bp, Homo sapiens
gcgcggagctctgtgggcgggtggctgttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgagatgtctctgcccacccacgcaacccagactatgaagagtccggtgaaagcagcagtagtggaggctctgagctggagccttctggccatcagctcttctgcttagaatacgaggcagacagtggagaggtcacatcagttatcgtctatcagggtgatgacccaggaaaggtgagtgagaaggtgtcggcacacacgcctctggatccacccatgcgagaagccctcaagttgcgtatccaggaggagattgcaaagcgccagagccaacactgaccatgttgaaggcgttctctccaggctggattcactgcactcggaagaattctgcccagggaatttagtgtgggggtaccaggaccagtttgtctgatcttgagacccccagagctgctgcatccatagggtgttgcaggactacacctggcctgccttgcaggtcattctttcttatatgttgacccatttgcccagcctgatatgcctggagtctcttgcttctagaaacacctttagccaagacaagaatctcgagcagaaac

SEQ ID NO: 442412 - DNA, 1850 bp, Homo sapiens
  misc_feature (705)..(705): n is a, c, g, or t
  misc_feature (756)..(756): n is a, c, g, or t
gcgcggagctctgtgggcgggtggctgttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgaggttcagctcatctcgtctctttccggaacctccacctcagcgctcccaaatctccgctgaatgattctcaccaagaactgggacgactcataagcccccagttaagcatcgctgtcagagtatcggggagccagcaagaagtttatctgccggtttgccccaccgtgctgtattttagtaaggtgctccgctacctagcaaagagaaagtctggcacagcgatgagcgaccagcacataattgcggaatgaacccagtaaatggcctttccccagcttctctgctacctagagatcacactggttaatatatgacggtcaatttttgttaagcattattactttttttaaaatgtttttattttatttttgagactaggtctctgtcgcccaggctggagtgcantggtgcgatctgggcttactgcagccttagcctcccgagtacctgggaccncaggcgtgtgccaccacaccggttaattttggtatttcttgtagagaaggggtttccccggctgggcgcggtggctctcgcctgtaatcccagcactttgggaggccgaggcgggcggatcacgaggtcaggagatcgagaccatcctggctaacatggtgaaaccccgtctctactaaaaatacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcaacacagcaagactcggtctcaaaaaaaaaaaaaaaaagagagagagagaaggggtttctccacgttgtccaggctgatctcgaactcctgagctcaggtgatctgcccgcatcggcctcccaaagtgctgggattataggtgtgtgccactacctttgttaggcattagtgaaagtgcttttagatcttacgtatattaattcattgagtctttatacaacctcataagaaagcttctgtctgtttcacagtcaggaaacaggcacagagaggttaaacaacttgcccaagatctcagctagtaaatggcagagcctggatttgaacccaggcagagctctatccacccttctgctttccagtactttttgctagacaaatgtgcattgtgtacctactgtgtgacaggattgtgctggcctcagagcagggatgcaaaggtaaataagtccttgattggcagcacaccaaatgcttacactggtccgggcgcggtgattcatgcctgtgatcctagcagtttgggaggccgaggtgggcggatcccttgaggccaggagttcgaaattaacctggacaacatggtgaaaccccatctctactaaaaatacaaaaattagccaggcatgatggcaggcggctgtaatcccagctacttgggaggctgaggaaggagaattgcttgaacctgggaggcagaggttgcggtgagccgagatttagccactgcactccagcctgggcaacagagcaagactccgtctcaaaaaaaaa

SEQ ID NO: 442413 - DNA, 566 bp, Homo sapiens
ttcttactgtggttcatccttccagatgtctctgcccacccacgcaacccagactatgaagagtccggtgaaagcagcagtagtggaggctctgagctggagccttctggccatcagctcttctgcttagaatacgaggcagacagtggagaggtcacatcagttatcgtctatcagggtgatgacccaggaaaggtgagtgagaaggtgtcggcacacacgcctctggatccacccatgcgagaagccctcaagttgcgtatccaggaggagattgcaaagcgccagagccaacactgaccatgttgaaggcgttctctccaggctggattcactgcactcggaagaattctgcccagggaatttagtgtgggggtaccaggaccagtttgtctgatcttgagacccccagagctgctgcatccatagggtgttgcaggactacacctggcctgccttgcaggtcattctttcttatatgttgacccatttgcccagcctgatatgcctggagtctcttgcttctagaaacacctttagccaagacaagaatctcgagcagaaac

SEQ ID NO: 442414 - DNA, 1944 bp, Homo sapiens
  misc_feature (799)..(799): n is a, c, g, or t
  misc_feature (850)..(850): n is a, c, g, or t
gcgcggagctctgtgggcgggtggctgttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgaggtgaggccgcccgccccgcctgcctccagcccgcgcgctcttcctgcaacgcactccccttctctatagggaaaaaccacttcttactcctaaggttcagctcatctcgtctctttccggaacctccacctcagcgctcccaaatctccgctgaatgattctcaccaagaactgggacgactcataagcccccagttaagcatcgctgtcagagtatcggggagccagcaagaagtttatctgccggtttgccccaccgtgctgtattttagtaaggtgctccgctacctagcaaagagaaagtctggcacagcgatgagcgaccagcacataattgcggaatgaacccagtaaatggcctttccccagcttctctgctacctagagatcacactggttaatatatgacggtcaatttttgttaagcattattactttttttaaaatgtttttattttatttttgagactaggtctctgtcgcccaggctggagtgcantggtgcgatctgggcttactgcagccttagcctcccgagtacctgggaccncaggcgtgtgccaccacaccggttaattttggtatttcttgtagagaaggggtttccccggctgggcgcggtggctctcgcctgtaatcccagcactttgggaggccgaggcgggcggatcacgaggtcaggagatcgagaccatcctggctaacatggtgaaaccccgtctctactaaaaatacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcaacacagcaagactcggtctcaaaaaaaaaaaaaaaaagagagagagagaaggggtttctccacgttgtccaggctgatctcgaactcctgagctcaggtgatctgcccgcatcggcctcccaaagtgctgggattataggtgtgtgccactacctttgttaggcattagtgaaagtgcttttagatcttacgtatattaattcattgagtctttatacaacctcataagaaagcttctgtctgtttcacagtcaggaaacaggcacagagaggttaaacaacttgcccaagatctcagctagtaaatggcagagcctggatttgaacccaggcagagctctatccacccttctgctttccagtactttttgctagacaaatgtgcattgtgtacctactgtgtgacaggattgtgctggcctcagagcagggatgcaaaggtaaataagtccttgattggcagcacaccaaatgcttacactggtccgggcgcggtgattcatgcctgtgatcctagcagtttgggaggccgaggtgggcggatcccttgaggccaggagttcgaaattaacctggacaacatggtgaaaccccatctctactaaaaatacaaaaattagccaggcatgatggcaggcggctgtaatcccagctacttgggaggctgaggaaggagaattgcttgaacctgggaggcagaggttgcggtgagccgagatttagccactgcactccagcctgggcaacagagcaagactccgtctcaaaaaaaaa

SEQ ID NO: 442415 - DNA, 1890 bp, Homo sapiens
  misc_feature (745)..(745): n is a, c, g, or t
  misc_feature (796)..(796): n is a, c, g, or t
gcgcggagctctgtgggcgggtggctgttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcggtaccgccccgccctgcgccgccgccgccaccactcctggcctggcctggcccggcccgacagtccctgactcccgctcggctccccgcagggacgactatgacaagaaggtgaagcaggcggccaaggagaagggaaaaaccacttcttactcctaaggttcagctcatctcgtctctttccggaacctccacctcagcgctcccaaatctccgctgaatgattctcaccaagaactgggacgactcataagcccccagttaagcatcgctgtcagagtatcggggagccagcaagaagtttatctgccggtttgccccaccgtgctgtattttagtaaggtgctccgctacctagcaaagagaaagtctggcacagcgatgagcgaccagcacataattgcggaatgaacccagtaaatggcctttccccagcttctctgctacctagagatcacactggttaatatatgacggtcaatttttgttaagcattattactttttttaaaatgtttttattttatttttgagactaggtctctgtcgcccaggctggagtgcantggtgcgatctgggcttactgcagccttagcctcccgagtacctgggaccncaggcgtgtgccaccacaccggttaattttggtatttcttgtagagaaggggtttccccggctgggcgcggtggctctcgcctgtaatcccagcactttgggaggccgaggcgggcggatcacgaggtcaggagatcgagaccatcctggctaacatggtgaaaccccgtctctactaaaaatacaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcaacacagcaagactcggtctcaaaaaaaaaaaaaaaaagagagagagagaaggggtttctccacgttgtccaggctgatctcgaactcctgagctcaggtgatctgcccgcatcggcctcccaaagtgctgggattataggtgtgtgccactacctttgttaggcattagtgaaagtgcttttagatcttacgtatattaattcattgagtctttatacaacctcataagaaagcttctgtctgtttcacagtcaggaaacaggcacagagaggttaaacaacttgcccaagatctcagctagtaaatggcagagcctggatttgaacccaggcagagctctatccacccttctgctttccagtactttttgctagacaaatgtgcattgtgtacctactgtgtgacaggattgtgctggcctcagagcagggatgcaaaggtaaataagtccttgattggcagcacaccaaatgcttacactggtccgggcgcggtgattcatgcctgtgatcctagcagtttgggaggccgaggtgggcggatcccttgaggccaggagttcgaaattaacctggacaacatggtgaaaccccatctctactaaaaatacaaaaattagccaggcatgatggcaggcggctgtaatcccagctacttgggaggctgaggaaggagaattgcttgaacctgggaggcagaggttgcggtgagccgagatttagccactgcactccagcctgggcaacagagcaagactccgtctcaaaaaaaaa

SEQ ID NO: 442416 - DNA, 690 bp, Homo sapiens
gcgcggagctctgtgggcgggtggctgttgttggggccgtcgaggcggcggcgactctgcgtccccggctcctgatggaggcggggccgcatccccggccggggcactgctgcaagcctggggggcggctggacatgaaccacggcttcgtgcaccatatccgacggaaccagatcgctcgggacgactatgacaagaaggtgaagcaggcggccaaggagaaggtgaggaggcggcacacgcccgcgccgacgcggccccgcaagccagacctgcaggtgtacctgccgcgacaccgagatgtctctgcccacccacgcaacccagactatgaagagtccggtgaaagcagcagtagtggaggctctgagctggagccttctggccatcagctcttctgcttagaatacgaggcagacagtggagaggtcacatcagttatcgtctatcagggtgatgacccaggaaaggtgagtgagaaggtgtcggcacacacgcctctggatccacccatgcgagaagccctcaagttgcgtatccaggaggagattgcaaagcgccagagccaacactgaccatgttgaaggcgttctctccaggctggattcacacgaccctccatgcaattaaccgccagggctcatacttggtgcaatgtccatttacataattcctgcggaagtatgtagt

SEQ ID NO: 442417 - DNA, 301 bp, Homo sapiens
ttgcaacgcctatgttaagcattatggggaaagttgaaaacgggaagttacacagtagtttctattatggcactccaactgcctttaaagactaaagagcaatagttttgattatggaaagcaaaagtgagttataaacaatagcatattttctatcatatcatctataattcattatttgagagaggaaaatatgagcagtaagtttatgttgcaagctttcttcacatggtaataattaaaatacaatggattgatcagccttctaatttccaaaatgcaattctttgctcgtacagcc

SEQ ID NO: 442418 - DNA, 546 bp, Homo sapiens
ttaattaaatgttgatgaacagttgaacaaaaggatgtttataccctgtattggccacgttaaatttatgttcagcttctgtatccattttttcttgtagctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgtaagttttcccagtagttgtagttggagggagccttgtttttaaacgggtctcagtgattaacatggaccctcctctcatcagcccagagtggggactggactccccatagggcacagtgtatatttgataaaggggcaagcagcacacctcaggggccaacagtattgggttgctgtttgaatccatagtgtccacatacttcccactgcccatagtcagagagtagccagtttact

SEQ ID NO: 442419 - DNA, 3384 bp, Homo sapiens
aacggtcattgatgatgcatccctggaagacctgggagccaggtctggctccttggactgtatcttccgtgctccagtgggagtacagactgagagggagaagggggctgggtagagatgcagcccatgtcgtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgca

SEQ ID NO: 442420 - DNA, 3507 bp, Homo sapiens
aacggtcattgatgatgcatccctggaagacctgggagccaggtctggctccttggactgtatcttccgtgctccagtgggagtacagactgagagggagaagggggctgggtagagatgcagcccatgtcggtatgggaatcactctacctctcatttccttcaatctttcactcctaaaatgtctagtaaaccttttagtctgttctattctgcattcattcccttgactttcagcccttgtaattcacattgtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgca

SEQ ID NO: 442421 - DNA, 3097 bp, Homo sapiens
ttaattaaatgttgatgaacagttgaacaaaaggatgtttataccctgtattggccacgttaaatttatgttcagcttctgtatccattttttcttgtagctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgca

SEQ ID NO: 442422 - DNA, 4223 bp, Homo sapiens
atccgaagtgcggctgcgcaagggtgacggcgcgcgagcaagggggagggggtgtttgggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaagaaaataaaaaaaaaagaaaaaaacaaaaaaaacaaagaaagaagcaggaggaggcggcgagacaatcaacatagatgccaggatagcgaaggcaaaacaaaccacagcaccccccatcattattttctattaaccgaccagcgacggcagacgagcgtggcggaatcgaataatcacagagcacatcggcggtacggcagcaaataaaaaaaggaggtagcaaaagagaagacagactacctaagagttagatagtagtcttgtataagaaacagaaaacttaccgtatgggagggtgaggaggagatgtaaaggtttgtcagagccacaatcaatagaatagtagtataaaaggccctagcgggatagtgtatcaattgaattgttggcgtaggtgagagtagtcgtgcaacaagttagattctgagggtgaagaaagataacaatacatgagagtgttagaaaac

SEQ ID NO: 442423 - DNA, 3001 bp, Homo sapiens
atccgaagtgcggctgcgcaagggtgacggcgcgcgagcaagggggagggggtgtttgggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtggaaggaatcgaattcctgcagcccgggggaccactagttctagagcggcccgcaacgcggtggagctccagcttttgttccctttactgagggtaattgcgc

SEQ ID NO: 442424 - DNA, 1105 bp, Homo sapiens
atccgaagtgcggctgcgcaagggtgacggcgcgcgagcaagggggagggggtgtttgggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgtaagttttcccagtagttgtagttggagggagccttgtttttaaacgggtctcagtgattaacatggaccctcctctcatcagcccagagtggggactggactccccatagggcacagtgtatatttgataaaggggcaagcagcacacctcaggggccaacagtattgggttgctgtttgaatccatagtgtccacatacttcccactgcccatagtcagagagtagccagtttact

SEQ ID NO: 442425 - DNA, 3656 bp, Homo sapiens
atccgaagtgcggctgcgcaagggtgacggcgcgcgagcaagggggagggggtgtttgggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgca

SEQ ID NO: 442426 - DNA, 3265 bp, Homo sapiens
gctaggaagcctgggttgagatcggccgagggctcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgca

SEQ ID NO: 442427 - DNA, 3477 bp, Homo sapiens
atccgaagtgcggctgcgcaagggtgacggcgcgcgagcaagggggagggggtgtttgggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgca

SEQ ID NO: 442428 - DNA, 2800 bp, Homo sapiens
tgccctggaacgattcccagaaacaacctgaatagttgaaacagcctaccaagaaaggccttggcctttccagctacttctgattatttattccagatttaccttttccccaacctatctccttcagtatctaggtcttaccgtttattaacattcacctcctctttctcctgtatacctaggggtggaacagagtgttatttctgtaatcagggcttgattttatgtggcttttatatgagggaagcccatcaaggtgggagtccagaaacaatatccctgccttaccctctctgctgatgccatggttatatctctcctctattttcagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagtctttctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccgtggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgca

SEQ ID NO: 442429 - DNA, 2863 bp, Homo sapiens
tggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaagaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaattt

SEQ ID NO: 442430 - DNA, 2867 bp, Homo sapiens
tacagcaaggcggggcgggcctggctgcccacacctcactgcgccctcggaccctaagcacacctgctcctagagagttattaatagagcccccaaatggcttacgctttcaaatgattttcctgcaaatctgatttcttgcatggcacatggcaattaggaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaattt

SEQ ID NO: 442431 - DNA, 1279 bp, Homo sapiens
aaattaggctaggtacgaggcctggtgtgtaatcggccgaggcggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaattt

SEQ ID NO: 442432 - DNA, 1105 bp, Homo sapiens
gagagagagagagagagagagagagagagagagagagagagagagagagagagagagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaattt

SEQ ID NO: 442433 - DNA, 995 bp, Homo sapiens
  misc_feature (60)..(60): n is a, c, g, or t
gtgaacacagtcattatggaaataatgctctgaggtatcgaaaaagtatttgggattaancctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaattt

SEQ ID NO: 442434 - DNA, 2917 bp, Homo sapiens
tggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaattt

SEQ ID NO: 442435 - DNA, 2809 bp, Homo sapiens
tggcgcggcgctgggtgacttcgcgtagcaggcagggaactggccgcggcgagcgggactggccattggagtgctccgctgcggagggaggggaccccgactcgagctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaattt

SEQ ID NO: 442436 - DNA, 481 bp, Homo sapiens
tactactactaaattcgcggccgcgtcgaccgacagaaggggagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442437 - DNA, 468 bp, Homo sapiens
taggtaaatagctataagccaaggcaactgagctaagaacagtatccacttatatcagtcatttattgatgccccctatggtttcatcttaatgttattttcctagaagtagttatgtgaagggccaaataacagcatagaaaaacactgctcagtgtttttctcttttttgattgtcaaattatcaagccgtattgaatattgtttttcaggtttccctagaaagagaacgacaacatgatcaaacacatgttcagagccaacttgaaaaattggatcttcttgaacaggagtataacaaacttaccacaatgcaggcccttgcagaagtcagtgcatgtgtctttttattgttaacatatatcagggtggtttttttttaatgttaattattttacatcactggatatttatagcattaaaagtgatcttataatgaagaaatatattggagttttaaaaagaaaa

SEQ ID NO: 442438 - DNA, 448 bp, Homo sapiens
agagccggcctgtaaccccggcgttgtctgccccagcggccccgttacgcgctaccttgtgacgtcaccagggaagaggcggattctctcctactacagaaagacgtctgctgttttgattggctaggaaagacgtccgttaggacgtgttgccctttctgtgggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcggtcctttgaccaagctgcacagtagctccatattaatttcccttaaaaatgttttatggctatcatacattttataatattaaatataagatttactttttgagaataataaaatgaataccttcatgttcctc

SEQ ID NO: 442439 - DNA, 3125 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442440 - DNA, 3203 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442441 - DNA, 3149 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442442 - DNA, 2241 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttcta

SEQ ID NO: 442443 - DNA, 3017 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442444 - DNA, 3183 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442445 - DNA, 2599 bp, Homo sapiens
tggcagaaacagaaggtagaagcagaagaaggcattaaaagctaccaaaaagactcttgatgaagaaagaaacagcagcagccgttctggaatcacaggtgggggactacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442446 - DNA, 2311 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaaggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaaggtgagttggtcaaactccggattctttttatacaacattgatccctgaattaagtccctgcatctgcaagtatgtctacaaatggaaggaacatttttctgtgcctttaccagtgtgtggatcacagtgatgtgaaaatgagatgtagggaggtttttggggattagggaagcaaggaagagatggggaggataccttaaagtagataaagtatatgtggaaaggaagtgataaaacagagaccctaagttgaagaaggtgttgtttcagataggggtcaaggaaataagaaatagtatgtttgtagcattggatttttagtatcaatcctgttgagttacatttagatataggtagatattcgaataagcacgtagcacattctgcttgtcctcacatccagatcatttctaggactaattctccaagaagcagtcatacgtacacttgaatcttcagtttcttcagcacttgaatgtaaagctgtattgtcatatatcaagtactgagtgaagtgcctaaaactgtgctagttgacactactttataagctgtttgtgttgctggtggttttatatttagattccaactagattgttattctggcatcttgggaagtaaatgttcttctgaattttg

SEQ ID NO: 442447 - DNA, 2749 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaaggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaaggtgagttggtcaaactccggattctttttatacaacattgatccctgaattaagtccctgcatctgcaagtatgtctacaaatggaaggaacatttttctgtgcctttaccagtgtgtggatcatgcctttaccagtgtgtggatcacagtgatgtgaaaatgagatgtagggaggtttttggggattagggaagcaaggaagagatggggaggataccttaaagtagataaagtatatgtggaaaggaagtgataaaacagagaccctaagttgaagaaggtgttgtttcagataggggtcaaggaaataagaaatagtatgtttgtagcattggatttttagtatcaatcctgttgagttacatttagatataggtagatattcgaataagcacgtagcacattctgcttgtcctcacatccagatcatttctaggactaattctccaagaagcagtcatacgtacacttgaatcttcagtttcttcagcacttgaatgtaaagctgtattgtcatatatcaagtactgagtgaagtgcctaaaactgtgctagttgacactactttataagctgtttgtgttgctggtggttttatatttagattccaactagattgttattctggcatcttgggaagtaaatgttcttctgaattttgtatttgtttatatttatttattttaaacccctagtaaattcgcagtgaaatcatggggaatataataaattagtggtgacaagcatttgaaaaaggtacagttgacccttgaacaacatgagtccgaactctgtgtgggtctacttacaggcagattttttttttcaataagtatcttggaaaattttttggagatttttggcaatttgaaaaaacttgcaaactatagcttagaaatatcagaagttaagaaaaagttggtatgtcatagatgcataaaattgactatgtcaatactagtgcattttatcatttattaccataaaatatacacaagttttttttaattataatttatcaaaacaatttgcacacagactacgtgacgccattcacagtccagagaaatgtaaac

SEQ ID NO: 442448 - DNA, 1255 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagatttttttttttttttttttttttacaataaggccttcagcggggtatccatttttttgggaatgggggggacaaccggcagctggcagagggggatcctcta

SEQ ID NO: 442449 - DNA, 2766 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacag

SEQ ID NO: 442450 - DNA, 3723 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaaggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442451 - DNA, 3247 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgtgtgcagactagggaaatgaagtacaatgttgaccagaattgataacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442452 - DNA, 2961 bp, Homo sapiens
tcaagataaaatgagagactggtatttatttaaaatatttgacaaacgttgatagattggttcaagacatagttatacagctgtaatatgtttttcagttagatactaccattggtttttacaggctttttacatgacacatctgaaatctgagtcatagcttttatttctacagcattaacttgaggctctcatttttcctagttgcagactggtctagaaacaaatagacttatctttgaagataaggcaactccgtgtgttcccaatgcaagaagaattaaaaaaaagaagtcaaaaccaccagaaaaggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442453 - DNA, 2494 bp, Homo sapiens
gagagatgtaaaaagtgttataggtgatctgagaatggactgattgattacctggcagttttaaggaagcctttaaaaataatatatttgaactgggttttaaagaatgatataaatgttgctaatacaccaaaaaaatgtcatctgcaaatatggtttgttcacaaaatggagagaaggggaggatgataggacatgaggctaggaaatgtaggttgcagctcaatgatgtgtatgtagggccttattttccattctgaaacatagttagtggatttatatcaaaggatttcaaatagaagaacatcatgatgagaataattttaggatttatatactctactttggggggtggagagttctttttacctaggcttagggaatagaaagtggtgtagagaatataacttcaattacttctttcatcatttttcttcctttagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatt

SEQ ID NO: 442454 - DNA, 2695 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaaggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaaggtgagttggtcaaactccggattctttttatacaacattgatccctgaattaagtccctgcatctgcaagtatgtctacaaatggaaggaacatttttctgtgcctttaccagtgtgtggatcatgcctttaccagtgtgtggatcacagtgatgtgaaaatgagatgtagggaggtttttggggattagggaagcaaggaagagatggggaggataccttaaagtagataaagtatatgtggaaaggaagtgataaaacagagaccctaagttgaagaaggtgttgtttcagataggggtcaaggaaataagaaatagtatgtttgtagcattggatttttagtatcaatcctgttgagttacatttagatataggtagatattcgaataagcacgtagcacattctgcttgtcctcacatccagatcatttctaggactaattctccaagaagcagtcatacgtacacttgaatcttcagtttcttcagcacttgaatgtaaagctgtattgtcatatatcaagtactgagtgaagtgcttatatttagattccaactagattgttattctggcatcttgggaagtaaatgttcttctgaattttgtatttgtttatatttatttattttaaacccctagtaaattcgcagtgaaatcatggggaatataataaattagtggtgacaagcatttgaaaaaggtacagttgacccttgaacaacatgagtccgaactctgtgtgggtctacttacaggcagattttttttttcaataagtatcttggaaaattttttggagatttttggcaatttgaaaaaacttgcaaactatagcttagaaatatcagaagttaagaaaaagttggtatgtcatagatgcataaaattgactatgtcaatactagtgcattttatcatttattaccataaaatatacacaagttttttttaattataatttatcaaaacaatttgcacacagactacgtgacgccattcacagtccagagaaatgtaaac

SEQ ID NO: 442455 - DNA, 1027 bp, Homo sapiens
tactactactaaattcgcggccgcgtcgaccgacagaaggggagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaagtcagtgcatgtgtctttttattgttaacatatatcagggtggtttttttttaatgttaattattttacatcactggatatttatagcattaaaagtgatcttataatgaagaaatatattggagttttaaaaagaaaa

SEQ ID NO: 442456 - DNA, 1288 bp, Homo sapiens
cctaataagccttttctgcagatttaccgtgaaggcagaggaaatgagtgtgattacagaaaactggaagaaatgcaccaaagattcctggtttcagagcgttcaaaagatgatcttcagctaagacttacgagagcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctgcagtgtgcatacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctgttttgagggttattggaaaacagagcagtgaccacttcctgtaagtaaagaaaatataatcctatattgagcttcagtggagaataaaccagctgagaagaactcattgccttcatcaatgtgtctgttttttaattcctcctttttcccttgaaaggacataataattttcaaactatgcaaatttctctttcataagaaagagtttttaagaaaattctagaatttaatatttcagtttccaagatttgagaattttacatctaattgttacttctaactcatttttaaagttcctaagtatccattttattatgaactcataaatgtaataaattgtgcactttctaaaatgatgctg

SEQ ID NO: 442457 - DNA, 1008 bp, Homo sapiens
cctaataagccttttctgcagatttaccgtgaaggcagaggaaatgagtgtgattacagaaaactggaagaaatgcaccaaagattcctggtttcagagcgttcaaaagatgatcttcagctaagacttacgagagcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcaggtagggagcatcctcttatccctagataataaacagttcaaagataagttttttagaagttcccagggaacttaatagtttatttttactagattaacatattttaaaattaatccctttaatatgtgaggttgaaaaagtaaacattggaaacaaaaataagctatgcgtggtggctcgcaactgtaatgccagcaatttgggaggcctaggcaggaggatcacttgaggccaggagttcaagaccatcctgcaaaacatggcaataccttttct

SEQ ID NO: 442458 - DNA, 1027 bp, Homo sapiens
cctaataagccttttctgcagatttaccgtgaaggcagaggaaatgagtgtgattacagaaaactggaagaaatgcaccaaagattcctggtttcagagcgttcaaaagatgatcttcagctaagacttacgagagcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctgcagtgtgcatacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctgttttgagggttattggaaaacagagcagtgaccacttcctgtaagtaaagaaaatataatcctatattgagcttcagtggagaataaaccagctgagaag

SEQ ID NO: 442459 - DNA, 1017 bp, Homo sapiens
ctgccccagctgcagcaagtgccacaataaacaagtggtagttcatgttcagctcagtagattcgcacatcctcaagaaattctcagagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctgcagtgtgcatacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctgttttgagggttattggaaaacagagcagtgaccacttcctgtaagtaaagaaaatataatcctatattgagcttcagtggagaataaaccagctgagaagaactcattgccttcatcaatgtgtctgttttttaattcctcctttttcccttgaaaggacataataattttcaaactatgcaaatttctctttcataagaaagagtttttaagaaaattctagaatttaatatttcagtttccaagatttgagaattttacatctaattgttacttctaactcatttttaaagttcctaagtatccattttattatgaactcataaatgtaataaattgtgcactttctaaaatgatgctg

SEQ ID NO: 442460 - DNA, 310 bp, Homo sapiens
ttacatatacgactcgagctggtaccctcgataaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggccttatcgagggtacctaactcgagtcgtatcgtcta

SEQ ID NO: 442461 - DNA, 1471 bp, Homo sapiens
cgaacgtgctggtgtgacggacgatctaaatggacgtgtgatgagaagtggtaccagaggatgctcacaagaactgggcttctagtcatcgagttccttcagtacgccgacgtatcttctgagctcaagtcgcatggcagttgaggcagttgcgcagattgtgattggttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagttcataatgtgccggatgactgaatacgactgtgaatttgcaaatgtttagatttgccacataccaaatctgggtgaaaggaaaggggccggggacaggagggtgtccacatatgttaacatcagttggatctcctatagaagtttctgctgctctctttccttctccctgagctggtaactgcaatgccaacttcctgggcctttctgactagtatcacacttctaataaaatccacaattaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcatagtggaggggagaggcagaactggaggagaggtgcagtgaaggttctctacagctaagcctgtttgaatgatacgtaggttccccaccaaaagcaggctttctgccctgagggacatcttcccactcccctgctccacatgagccatgcatgcttagcaatccaagtgcagagctctttgctccaggagtgaggagactgggaggtgaaatggggaaatggaagggtttggaggcagagctgaaaacagggttggaaggatttcctgaattagaagacaaacgttagcatacccagtaaggaaaatgagtgcaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcactaaaaaaaaaata

SEQ ID NO: 442462 - DNA, 1492 bp, Homo sapiens
tgatgttaaataaatgcttttattccaagctgttaacccacaggtccttgaggtactttctggaggcagcaggggtgagctgaccaccagtgatgaacagaggcctccacacagccagtgacctaattagtcaccttcaagggtgacctgaactcacagatttgtcggttcttgggaaactgcataaagatgtcttctaagagcaaagtgagattaagtgtcccttcagttcccagatcctccaaatgttctctgctgctgtttccccagcagcgattcttcctgccatgtcctttctcactgacattcattttctgactctccctcccacagggatcgccagtggaagttcataatgtgccggatgactgaatacgactgtgaatttgcaaatgtttagatttgccacataccaaatctgggtgaaaggaaaggggccggggacaggagggtgtccacatatgttaacatcagttggatctcctatagaagtttctgctgctctctttccttctccctgagctggtaactgcaatgccaacttcctgggcctttctgactagtatcacacttctaataaaatccacaattaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcatagtggaggggagaggcagaactggaggagaggtgcagtgaaggttctctacagctaagcctgtttgaatgatacgtaggttccccaccaaaagcaggctttctgccctgagggacatcttcccactcccctgctccacatgagccatgcatgcttagcaatccaagtgcagagctctttgctccaggagtgaggagactgggaggtgaaatggggaaatggaagggtttggaggcagagctgaaaacagggttggaaggatttcctgaattagaagacaaacgttagcatacccagtaaggaaaatgagtgcaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcactaaaaaaaaaata

SEQ ID NO: 442463 - DNA, 752 bp, Homo sapiens
ttagagtgacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacgccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagttcataatgtgccggatgactgaatacgactgtgaatttgcaaatgtttagatttgccacataccaaatctgggtgaaaggaaaggggccctccagctttccactgcagagaaagtggttgttgctcctcggtatatgtaatcataattgtagatcgaattc

SEQ ID NO: 442464 - DNA, 1733 bp, Homo sapiens
ttagagtgacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacgccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagttcataatgtgccggatgactgaatacgactgtgaatttgcaaatgtttagatttgccacataccaaatctgggtgaaaggaaaggggccggggacaggagggtgtccacatatgttaacatcagttggatctcctatagaagtttctgctgctctctttccttctccctgagctggtaactgcaatgccaacttcctgggcctttctgactagtatcacacttctaataaaatccacaattaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcatagtggaggggagaggcagaactggaggagaggtgcagtgaaggttctctacagctaagcctgtttgaatgatacgtaggttccccaccaaaagcaggctttctgccctgagggacatcttcccactcccctgctccacatgagccatgcatgcttagcaatccaagtgcagagctctttgctccaggagtgaggagactgggaggtgaaatggggaaatggaagggtttggaggcagagctgaaaacagggttggaaggatttcctgaattagaagacaaacgttagcatacccagtaaggaaaatgagtgcaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcactaaaaaaaaaata

SEQ ID NO: 442465 - DNA, 641 bp, Homo sapiens
ttagagtgacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacgccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagtcatatcgccagtcacgagatggtcccgagctcgattcactgcctcgttcc

SEQ ID NO: 442466 - DNA, 3336 bp, Homo sapiens
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttagggtgtccttgcagggtgtctgagctaaacttcaccaaataatagctgtttgtattttggctgctgcaggagccattttagaaataaatatcttccttcaatagatgaaaatgaaaatacag

SEQ ID NO: 442467 - DNA, 2605 bp, Homo sapiens
tcgaatcgtaaccgttcgtacgagaatcgctgtcctctccttgctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttagggtgtccttgcagggtgtctgagctaaacttcaccaaataatagctgtttgtattttggctgctgcaggagccattttagaaataaatatcttccttcaatagatgaaaatgaaaatacag

SEQ ID NO: 442468 - DNA, 2675 bp, Homo sapiens
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcagacaaaagatctccttgaggacaaggcccacatcttctcccaagttgtgtttgttgtattgaccagcacaatgtctggcatatagtaaactctaaatgattcaaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaagtgagtgtccctcctccccataccctggtggcagcccggctcagactgcttcgattcctgggaaccccacagggagagcacttcatgctcttgtgctacttctgtgcaaggtctagaaagacaggatgtgttatctgtggtctaagctggctcagaattcatgttacagctcctataactcctttaacagtacctctgctctcccgcagaacctggcccctctgccactgcattgtatatacccctgaggattttt

SEQ ID NO: 442469 - DNA, 1412 bp, Homo sapiens
  misc_feature (1406)..(1406): n is a, c, g, or t
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcagacaaaagatctccttgaggacaaggcccacatcttctcccaagttgtgtttgttgtattgaccagcacaatgtctggcatatagtaaactctaaatgattcaaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgaattccaccacactggcggccgcaaggagaggacagcgatctcgtacgaacggttnccatgg

SEQ ID NO: 442470 - DNA, 1775 bp, Homo sapiens
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcagacaaaagatctccttgaggacaaggcccacatcttctcccaagttgtgtttgttgtattgaccagcacaatgtctggcatatagtaaactctaaatgattcaaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggtaaccactaggatgattgctgtttaccttagctgccctggatcccagaacatcatgatagggcctggcttggctacagagcatccgtgatgctctatgctatggtgtcagctggatgacaggcttagggccttggtcagggggtgaaactgaatgaaaagtaaatgtcgacccttccaactaattagagagtgtggttctttccgttaaatcaaatgatgtttcacagtggtagcctccagatatagactagaactactaattattattattatcagaaataaagatactaatcttgaaaaaaaaaaactttaaaccccaagggatctcgaccaggggggggacagggattctcgtccaaccggttccaatttg

SEQ ID NO: 442471 - DNA, 1761 bp, Homo sapiens
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcagacaaaagatctccttgaggacaaggcccacatcttctcccaagttgtgtttgttgtattgaccagcacaatgtctggcatatagtaaactctaaatgattcaaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggtaaccactaggatgattgctgtttaccttagctgccctggatcccagaacatcatgatagggcctggcttggctacagagcatccgtgatgctctatgctatggtgtcagctggatgacaggcttagggccttggtcagggggtgaaactgaatgaaaagtaaatgtcgacccttccaactaattagagagtgtggttctttccgttaaatcaaatgatgtttcacagtggtagcctccagatatagactagaactactaattattattattatcagaaataaagatactaatcttgactccgctgcgcgccggcactattttataattctattcataaataaagtagaacgatatcgtc

SEQ ID NO: 442472 - DNA, 1681 bp, Homo sapiens
tcccacatctggtcctgcccactaacctgagtctcacacagactccccctctgaattagggatgcacagtgacttgccttttgcatttcaccatcctgtccctgtcccacctctgtctgtgccttttcttgtgctacattccttccctatccttggctaaggctccccttgaagttttaggtcaaatgttccttttctcccagccaggttgtaagttcccaaagggcacaggttatgttacacctttcttaatcctcacagggtacttgggaaatcttactgacaaactaaatggtcctggagtttatttgtttactaaggaggagaccaagtgcatggccttccttcctaccaccaccacctgtgggctaaggagtagggtctgccatccagagcacagcccaactctgttctaacaaaccccagcccagctcttctaaaacccgtgtgtaacaccccccttggctatccacttgccctatgctgtctttctgtttcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttagggtgtccttgcagggtgtctgagctaaacttcaccaaataatagctgtttgtattttggctgctgcaggagccattttagaaataaatatcttccttcaatagatgaaaatgaaaatacag

SEQ ID NO: 442473 - DNA, 412 bp, Homo sapiens
aactactaattattattattatcagaaataaagatactaatcttgaatcttgactaatgctctaattcttgatatgtagacgattcgggcattttcactcagtttgttggttaagatggtcatgtgtcatgtacagtaaacgagttaacccagaggggtgggaaagttccatggtgtggcaggggcaacagtggcagcctcactagttcctttgttctccacacagtgcaacacattagagtttatatgtgtccagttaagtggctttatggattctattttctggttttagccaaactaaataaccggtggctttaaaagattactgcaaagattggagttgatatattttttgaaagctaacataaacaagcaagaaaatggcagggtccagtttggagttcttcatcaa

SEQ ID NO: 442474 - DNA, 3440 bp, Homo sapiens
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcagacaaaagatctccttgaggacaaggcccacatcttctcccaagttgtgtttgttgtattgaccagcacaatgtctggcatatagtaaactctaaatgattcaaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttagggtgtccttgcagggtgtctgagctaaacttcaccaaataatagctgtttgtattttggctgctgcaggagccattttagaaataaatatcttccttcaatagatgaaaatgaaaatacag

SEQ ID NO: 442475 - DNA, 3552 bp, Homo sapiens
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcagacaaaagatctccttgaggacaaggcccacatcttctcccaagttgtgtttgttgtattgaccagcacaatgtctggcatatagtaaactctaaatgattcaaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttgaacccatcactgaggaacgtgctgcaagaactctgtaccgcattgaactgttacggaaagtccgagagcaagtgctcaagtgccctcagctgcatgaacgcctccagctgtgcaggcccagcctctacctcccagtctggtgggagtgtgggaagcatgatcgagacctgctcatcggcactgccaaacatgggctgaaccgcactgactgttacatcatgaacgacccccagc

SEQ ID NO: 442476 - DNA, 2524 bp, Homo sapiens
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcagacaaaagatctccttgaggacaaggcccacatcttctcccaagttgtgtttgttgtattgaccagcacaatgtctggcatatagtaaactctaaatgattcaaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaagatacacctatgagcgaattgatgggcgagtacggggaaacctgcgccaggcagccatcgaccggttctgtaagccagattcagaccgctttgtctttcttctgtgcaccagagcgggaggcctggggatcaatctcacagctgctgatacctgcatcatatttgattctgactggaacccacaaaatgacttgcaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccaggtaaagcaaatgaaa

SEQ ID NO: 442477 - DNA, 3244 bp, Homo sapiens
tcgaatcgtaaccgttcgtacgagaatcgctgtcctctccttgctcgagatccattgtgctctaaaggaaaaaactgtattttggctgatgagatgggcctagggaaaaccatccagtccatcacattcctttcagaaatatttctgagaggaatccacggcccttttctcattatcgcccctctctccaccatcactaactgggagcgggagttccggacatggacagagatgaatgccattgtgtaccacggcagccagatcagcaggcagatgatccagcagtatgaaatggtgtacagagacgcccagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggaacataaagtgcttctcactggaacacccttgcagaactctgtggaggagctcttcagtttgttaaattttctggagccatcacagtttccttcagagaccgctttcttggaggaatttggagatctgaaaacagaggagcagacaaaagatctccttgaggacaaggcccacatcttctcccaagttgtgtttgttgtattgaccagcacaatgtctggcatatagtaaactctaaatgattcaaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaaggctcaggcccgatgtcaccgcataggccagagcaaagctgtgaaggtgtatcgcctcatcactcgaaattcctacgagcgcgagatgtttgacaaggccagcctaaagctggggctggacaaggctgttcttcaggacatcaaccgaaagggcggcaccaatggggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggctagctttgtggcttcaggaaacagaacagatatttccttagatgatcctaacttttggcagaaatgggctaaaatagctgaactagacactgaagcaaagaatgaaaaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttagggtgtccttgcagggtgtctgagctaaacttcaccaaataatagctgtttgtattttggctgctgcaggagccattttagaaataaatatcttccttcaatagatgaaaatgaaaatacag

SEQ ID NO: 442478 - DNA, 1684 bp, Homo sapiens
gcatggttctatcccaaatgtgtcctgaggatacacttatgctttgtgaaaggagtagagaaaagaggactttcttcccagtagtcctctccatttctaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttggctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggcttatctgccccagtccccagagggaggaaggggaagaagacgaagaaccagttgctaatcccagagctaaaggatgcagattggctagccacctgcaaccccgaggtggtcttgcatgatgatggctataagaaacacctcaaacagcactgcaacaaagtacttttgcgagtccggatgctgtactacctaaaagctgaaatactgggagaagcagctgagaaagcatttgaaggatctcctgccagggagctggatgtacctctgcctgacatcgactacatggagatcccagtggactggtgggatgctgaagccgataagtcacttctcattggcgtgttcaagcatggttatgaaaggtacaatgccatgcgagcagacccagcactttgcttcctggagaaagttgggatgcccgatgagaagtccctttctgcagaacagggtgttacagatgggacctcagacattcctgaaagaggcaacacagataaagaagacaatgctgaggacaaagtagatggcctccagaaacaaacggagagttccagtgatggaggtgatggcgtttttagcgaaaagaaggatgacagccgggcagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattgggttcaggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttagggtgtccttgcagggtgtctgagctaaacttcaccaaataatagctgtttgtattttggctgctgcaggagccattttagaaataaatatcttccttcaatagatgaaaatgaaaatacag

SEQ ID NO: 442479 - DNA, 597 bp, Homo sapiens
tcgaatcgtaaccgttcgtacgagaatcgctgtcctctccttgctcgagatccattgtgctctaaagggaagagatgttcaggagaacctcagaaatggacctcatcaacaaggaagcccaaaagaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtcccccagataccaccatctacgttgaacccatcactgaggaacgtgctgcaagaactctgtaccgcattgaactgttacggaaagtccgagagcaagtgctcaagtgccctcagctgcatgaacgcctccagctgtgcaggcccagcctctacctcccagtctggtgggagtgtgggaagcatgatcgagacctgctcatcggcactgccaaacatgggctgaaccgcactgactgttacatcatgaacgacccccagc

SEQ ID NO: 442480 - DNA, 2287 bp, Homo sapiens
tcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagcc

SEQ ID NO: 442481 - DNA, 602 bp, Homo sapiens
atcagccagaggtttcaagccatggaatggaggaaaggcggcagagaggagcagcaccagaggccaggagagagtggaaagggccacagcttgtttttaaaaaattctataatttggaagagggtggcgattaattttccaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacatttgtcttacgactcaggtggtgtgtacaccacctgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtatgcttacatatatttaagga

SEQ ID NO: 442482 - DNA, 3261 bp, Homo sapiens
tcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgaaaaaaaaaaaaaaaaaaaaaaaaaaaaaaaaagggggggggggtaaaaaattccccggggggggccaattggggtcccgttttttgttgcacaaggggggccccataatggggagcggtgtaatatataaaggctaagggaatgggccggggtttaaacaaggcttgtaactggggaaaaaagtgggtatcctgggagccactctggtgggaaagggaacccttttattctggggggggtgcgccaattagtgggaacatctaccttaagggatattataaaggctcaaagggagaacaatataaaatttcacgggtggctatagtggtgtacacacggggaatattatgtgggtgtaaaaagtgtggacaaggagattgttgtaaacgagtttc

SEQ ID NO: 442483 - DNA, 2886 bp, Homo sapiens
tcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcaattaacgcctgatgcataaattaaccctcgggtcggcgggtgggggtggcggttgtgcg

SEQ ID NO: 442484 - DNA, 2662 bp, Homo sapiens
  misc_feature (2659)..(2661): n is a, c, g, or t
tgactctagagtatccctcacagcttcgggctaacctctgactctggtaggtgggacctctgttaacgcttcagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaannna

SEQ ID NO: 442485 - DNA, 3336 bp, Homo sapiens
  misc_feature (3333)..(3335): n is a, c, g, or t
tcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaannna

SEQ ID NO: 442486 - DNA, 3398 bp, Homo sapiens
  misc_feature (3395)..(3397): n is a, c, g, or t
tcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctaagcagagtgaagaaaactaaaatccagtttattgtatttcaatactatgtcataacagtcaggtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaannna

SEQ ID NO: 442487 - DNA, 2135 bp, Homo sapiens
tcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagaggggtgtggaatctgaccctccacatgttgctttattgagggcacaccagtcc

SEQ ID NO: 442488 - DNA, 8134 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442489 - DNA, 3952 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggaggaagacacagcaccctggagatgttaaggcagaagtcagttcttctgtccatccctctccccagccaggatagagctatcttttccatctcatcctcagaagagactcagaagaaagatgacagccctcagaatgcacgttatgaggaaggcagaatgtgggtctgtaattcctccgtgtcccttctccccctctgcaaaccgtcgtaacaataatagttcctaacacatgggacaattgtgaggattaaatgagttagcctgcagaaatcacttgatgcacagcacatgggaagcattgtgtgtatttattaatccttcacaaagtctttgagatatatttttatcaaatatttagcatggatcccggtacactttcaatacttaataaatggtcaatgttattctttttcactattattgctatttatgtgctcttattggcggcattgttgtatcaccagttggttgtacccatcggtcctctccaagtcacacagctactctgcgataattcccccggtgtctccttattcctcgggagccccagagtggataaaggtattggtggttttagtggtattttcatttgagttttgtttccttggataaacccaaacaggagaccttcccataaccactgttccacaagaccaaatggtaaactgttaaagttgaaaggaccttaaacttctttgctcaaagccctatattttactcatgagacactcgaggcccagggagtttcagtgattttccgaactagaggcagacctaacatccaggt

SEQ ID NO: 442490 - DNA, 1768 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtgggtaaaagaaatcattgagtcccccgccttcagaagagggtgcattttcaggaggaagcgatggcttcagacagcatatttgagtcatttccttcgtacccacagtgcttcatgagaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgac

SEQ ID NO: 442491 - DNA, 4183 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgac

SEQ ID NO: 442492 - DNA, 1228 bp, Homo sapiens
ggagaaggcttaccagccactctgtttactttattggggccattgccttcctacttttgaagttcattgggaccaagtgcttatcatccaaacccagtcaacatctaatccacttttatgagtatgcgtgcctcactttgagtgttccatatggccaagaggggtccctgacctctcaaatcatctcttgatttttagtattccaagtaacttctgtcttgctaattattttcccccaaaattaaagttacttaggaaggactatattctggtgctgctgtctgcaaaactctgagatactgaaatgaccctgtttctcagttgtatagagttatttaagtccgtctgattctctctttatcatctggatagacaaaaggaagaaaacctttccaccttcctgtaggagaaggagataaatcctctttccagccttggagaggaagacacagcaccctggagatgttaaggcagaagtcagttcttctgtccatccctctccccagccaggatagagctatcttttccatctcatcctcagaagagactcagaagaaagatgacagccctcagaatgcacgttatgaggaaggcagaatgtgggtctgtaattcctccgtgtcccttctccccctctgcaaaccgtcgtaacaataatagttcctaacacatgggacaattgtgaggattaaatgagttagcctgcagaaatcacttgatgcacagcacatgggaagcattgtgtgtatttattaatccttcacaaagtctttgagatatatttttatcaaatatttagcatggatcccggtacactttcaatacttaataaatggtcaatgttattctttttcactattattgctatttatgtgctcttattggcggcattgttgtatcaccagttggttgtacccatcggtcctctccaagtcacacagctactctgcgataattcccccggtgtctccttattcctcgggagccccagagtggataaaggtattggtggttttagtggtattttcatttgagttttgtttccttggataaacccaaacaggagaccttcccataaccactgttccacaagaccaaatggtaaactgttaaagttgaaaggaccttaaacttctttgctcaaagccctatattttactcatgagacactcgaggcccagggagtttcagtgattttccgaactagaggcagacctaacatccaggt

SEQ ID NO: 442493 - DNA, 284 bp, Homo sapiens
tgtcggtcgaagtggaagagggaaaagcttcactctgaccatcactgtcttcacaaacccaccgcaagtcgccacctaccacagagccatcaaaatcacagtggatgggccccgagaacctcgaaactctttgacctggcctcggtatcctcacatttaaaatgaggagttggcttatatgattggctggcatatttggctcatctcgaagactgtctattatagaagggcaaatggtagtgcctcattgcaggtgtggagcctttgacttgaggtatgcgtgc

SEQ ID NO: 442494 - DNA, 265 bp, Homo sapiens
  misc_feature (241)..(241): n is a, c, g, or t
tgtcggtcgaagtggaagagggaaaagcttcactctgaccatcactgtcttcacaaacccaccgcaagtcgccacctaccacagagccatcaaaatcacagtggatgggccccgagaacctcgaagtaagtgcatccacttggggctggtacaccctccaggctggtacaccctccaggctggtatactcagggaccatgtctcagattccttgggttcaacctttcccccagggggatgncaggcccccgtaaagccaaaaagt

SEQ ID NO: 442495 - DNA, 426 bp, Homo sapiens
ttctggatactgcagttcccgtgaattaatggtcacccctaactaacattctcaggaaaaccagtagggttgccccagagcccctcactctgctgcttatttggaaggagcctttatagttctgctgtgtgagaggctctgagccaccatatgttcctaaatgagagaagccgttgcccagacatggatctgtttaatttaatatgatttaccacaaattacgaagcatgacttcaaaattgaatttgtgcaaaattactgatggccaattcagtggaagggaagggaaatcttgttattcctattccagaatctcttcctgatttcctcatttgattctttcacgccttggggtaggggaggggaatgcattcgcggctctataaagaattgtccttattttcgaactttctccctggtcacaca

SEQ ID NO: 442496 - DNA, 929 bp, Homo sapiens
ggagaaggcttaccagccactctgtttactttattggggccattgccttcctacttttgaagttcattgggaccaagtgcttatcatccaaacccagtcaacatctaatccacttttatgagtatgcgtgcctcactttgagtgttccatatggccaagaggggtccctgacctctcaaatcatctcttgatttttagtattccaagtaacttctgtcttgctaattattttcccccaaaattaaagttacttaggaaggactatattctggtgctgctgtctgcaaaactctgagatactgaaatgaccctgtttctcagttgtatagagttatttaagtccgtctgattctctctttatcatctggatagacaaaaggaagaaaacctttccaccttcctgtaggagaaggagataaatcctctttccagccttggaggtaaaatatccaactgcattgcattgctttcctttctctctccctctccttccctctcttccttactcttctagcaatttgaagtttgaaaacaaagggagtagggactatttgattaccttgaaagtggaggctacaatcaaacaccagaaatcctcatatgtgaatctataaatggtcatttaatggttacacaaagtaacatattcagaatgtgagaaattaatttatataataggctataaacatgacaggtgaatgatttcatttaaaaatagcttttaacaaggtgtagtagggtatgagagcctttccaggtctatagcattataatcttaccccgacaacaagcctgaatcaggtgttcacaggaataaataaaaataattaaaggaaagaagggagagagagagaagaaatgaaaaccagtgggatgactgcagagattcactgcagggcttgatcttagtgatgaaatatttcttctgt

SEQ ID NO: 442497 - DNA, 485 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtgggtaaaagaaatcattgagtcccccgccttcagaagagggtgcattttcaggaggaagcgatggcttcagacagcatatttgagtcatttccttcgtacccacagtgcttcatgagagggacaacgcttactccatagagttcttgtgaagttagtgggagatgatgcaagtcaagttctcttctagtccagggcctggaacacagtaagcactcaacagatgctcctttgcttcctccttcctatgtgatcactaagtatgcctagtaggccattgactttcgcatgatcaaagcctgagatgagtt

SEQ ID NO: 442498 - DNA, 7942 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442499 - DNA, 6041 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442500 - DNA, 5424 bp, Homo sapiens
cccgtcctcctgggcatagcatcctgggtgacctcatctttttgggtggcagattctgggtagaaaccctctccctaggcagcagcatcctcagtagcccccatcctcccaggtggtagcaatcctgtgtggttccaatcttcctgggcggtaaattctgatagaaacccatctccctggacagtagcatcctgggtgtcccccgtcctcctaggcggtagcatcctgggtggtctccatcctcccaggtggtgtcatcctgggtggtctccgtcctctcaggaggtggcatcctgagtggtccccgacctcctgggcatagcatcatgggtagtccccatcctcttgggaggtgacatgctgggtgatcctcgtcatctcaggaggtggcatcctgggtggtccctgtccccctgggtatagcatcctgggtaatcctcgtcctcttgggagtagcatcccgggtggtccccgtcctccccggcagtagcatcctgggtggcttcccatcctcctaggcggtatcatcctgggtagccccctggggcagagggaagagctgtggcctccgcaacctcctactcacttccgctccgttctcttgcccgccctgcagcggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442501 - DNA, 6313 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccacataaaaaaaatagtttagctgataatattttttttttataattatattgtgtatagaaaaataaacttcgtgggggggcccgggaaccaatttcccctatagggaagttattttcgccccccttaattgggggttgttttaaaacgtcgggaatggggaaaacccgggttttacccaatttaatggacgttgaaaaaaattcccctttttgcaa

SEQ ID NO: 442502 - DNA, 4181 bp, Homo sapiens
  misc_feature (57)..(57): n is a, c, g, or t
tctctctctctctctctctctctctctctctctctctctctctctctctctctcctntggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442503 - DNA, 6049 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442504 - DNA, 5018 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagtatgaccatgaatgcgacatcgcgatcgtcatcagtttggactacagactagctgctcgatatatctgcatctatgggacagtcgtcctgatattagttactgtg

SEQ ID NO: 442505 - DNA, 3748 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggatgctgctgttcaggagccaccagagccttcctctctttgtaccacagtttcttctgtaaatccagtgttacaatcagtgtgaatggcaaataaacagtttgacaagtacatacacca

SEQ ID NO: 442506 - DNA, 3217 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaactgcctccaaattatgaagcccgtgaaccaagacagaccaattagcttgtgaccaattgtctaacttcggacctatacttatgaggaagctcatctttctccctaattcatcccaggacaagcctaggaaaccctggtgttacctccaagaggaaagacatacacatcaaatgcagcggtatgctgataaatgttacccctggatccccagaaaataaataaagtcccaatttatagaaaaaaaa

SEQ ID NO: 442507 - DNA, 3655 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaaacagttgtgattacttcaggtttcaccagatgccttagctgctgttcagagcttcacagaatgccttctaagagcttcacaacggcagtactattgacatttggggccaaataattctttgttggggggggtctgtcctgagcatcggagaatatttagcagcatccttggcctctagatgccaatagcatccccctcaccccagttaggacaataaaaaatgtttccagacattgccaaatttcccaaggggcaaaactgtccccaggtgagaaccactgccttccagtgttcttgggtggtacagtaaaataggaaaaccaacttaa

SEQ ID NO: 442508 - DNA, 689 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtgcattttttaatagggcttggggagtcccagaggtatccagcagaggggagaagaaagagagatgtagggctagaggggtgaggctgaaacagtgacctgtcttggttttcgctccgaaggtgtaaaagaaatcattgagtcccccgccttcagaagagggtgcattttcaggaggaagcgatggcttcagacagcatatttgagtcatttccttcgtacccacagtgcttcatgagagctctaagagactctgcgaagagacacattgctttggaggaatcagccccaggccaaagcaacaagcaacaccagagtcctgcggagagctgagaagcaactcgcccactcagacatagcccatcgtttgtctaactgttagcattctgctctaatccaatctgcatgcctcttgctccattccc

SEQ ID NO: 442509 - DNA, 172 bp, Homo sapiens
atcaaattatagcagattagggggcaggcacaggggcagtggagtcatgtctgccattttaaatgttgtgtaatgttgtgttttccagacagttgtgattacttcaggtttcaccagatgccttagctgctgttcagagcttcacagaatgccttctaagagcttcacaacg

SEQ ID NO: 442510 - DNA, 6222 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtgcattttttaatagggcttggggagtcccagaggtatccagcagaggggagaagaaagagagatgtagggctagaggggtgaggctgaaacagtgacctgtcttggttttcgctccgaaggtgtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442511 - DNA, 4085 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatgggcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgac

SEQ ID NO: 442512 - DNA, 3326 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaatgcagggtcgggcagtggttttaatggaggctttggctcaagcatggattctaagtcttctggctggggaatgtagacagtggggttgtggttggttggtatagaatggtgg

SEQ ID NO: 442513 - DNA, 6098 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442514 - DNA, 5635 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaaccttttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442515 - DNA, 5185 bp, Homo sapiens
tatcaggtgaaaatctccaagaatcagtctcttttgggggaaaataatccaacagaggcagatacttggacttgagtaggcttattaaaccctggtacataggccacatacatgtatgtgacatatttgaacaagggccactcatttcttattaaaagacattttttaaatcccaccccactttacatataattgacctttctgattctcttcagatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442516 - DNA, 4942 bp, Homo sapiens
ctgcctcgcaggtcagactcctagacggatcccacgaatactcgacaacgttgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacacca

SEQ ID NO: 442517 - DNA, 5650 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccacgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattacagcataactatacagcataaactattacagcataaactattatagcataaactattacagcataaactattacagcataaactattacagcataaactattacagcataaactattgaataacaatctccaggctgtcacctgctagactggctaaaatccaaaagtaaccactctggagaaacaggcattcctagacagtactggtgggatacagatatggtacaattctcatgaaatttcacagtagttaacaaatttaacatatttatactttttaacccaggaatcccatgtttaggagttccagtgagatagatacagtcctacctat

SEQ ID NO: 442518 - DNA, 3320 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggctcatctttctccctaattcatcccaggacaagcctaggaaaccctggtgttacctccaagaggaaagacatacacatcaaatgcagcggtatgctgataaatgttacccctggatccccagaaaataaataaagtcccaatttatagaaaaaaaa

SEQ ID NO: 442519 - DNA, 3128 bp, Homo sapiens
ctacaaggcccgggagcaagccgcgtggctgctttcaactttccttccagccgcgcgttcttggggtctttcctgactaggaaactcctcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagccccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaactcatctttctccctaattcatcccaggacaagcctaggaaaccctggtgttacctccaagaggaaagacatacacatcaaatgcagcggtatgctgataaatgttacccctggatccccagaaaataaataaagtcccaatttatagaaaaaaaa

SEQ ID NO: 442520 - DNA, 1420 bp, Homo sapiens
ggaaaggggaacagttaaatttgtaatttgggttgtgtgaaaacttctttgggcctcataaacaaccacagaaccacaagttgggtagcctggcagtgtcagaagtctgaacccagcatagtggtcagcaggcaggacgaatcacactgaatgcaaaccacagggtttcgcagcgtggtgagcatcaccaacccacagccaaggcggcgctggctttttttttttttttaatctttaacaatttgaatatttgtttttacaaaggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaa

SEQ ID NO: 442521 - DNA, 2352 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagtta

SEQ ID NO: 442522 - DNA, 3487 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagtgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgactacaaaaaggattagactgagccgaat

SEQ ID NO: 442523 - DNA, 1124 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataaggattcactttaagagatttggaaactcttccctttggaattgctcttcccatcagagatgcaatttatcactgtcgtgaacagcctgcctcagactggccagaagctgtctgtctcttgattggacgtcaggatctttccaagcaggcctgcgaaggaaacttacccaaagggaagtctgtgctctcatcagatgttccttcaggaacagaactgacgagccagatgccggtttaatgccctgcatccagaagggtccggctattatatcgcagtgaccaattacacggcgcagaatggtcgccagaggctatcccagaggcgcacacaaggaaagcggacagcaaagcgaggacccaaagaccagcgagcccaagcacaagaggccgaacgagacccgacaggccacccgggcagcaacaaaacggacaccgagcagaccagcaagacaccgga

SEQ ID NO: 442524 - DNA, 753 bp, Homo sapiens
ataagaagcctgcaaagccagctgcaaaataaggaaagtgaagtgcttgagggggcagaacgtgtaaggcatatctcaagtaaagtggaagaactgtccgtgtcaatgtagtgcagtacccagagctcagtgaccacgagttcatcgaggaaaaggaaaacaggtgaaagaaaacacgtgcactatctcttgtcatgtttcattgttacatttgtgtcttgtgtatatttgtttttccttcaagtttttagcatttaaaaccctaaagagatttaaaagatactttcaagtgaaaatatgccctgtgttttaagttttcatccaacttcaacaaacacgtgtgttagcaaaatgtctttggcttttgaggacgtaattgttgtatttcatatcgtcctcctcttgaaatacatataacactttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttgtatgagtattttttttttttggatatgatagatgatactccaaataaaaatagataagcctttcttctgccactcccctgcacaggatacatcccttgatacattataagactcacatgcctatgacattccagagctattctcttgggacacttctgttttaaaattctctcctgttcttt

SEQ ID NO: 442525 - DNA, 388 bp, Homo sapiens
ccatgattatatgcaaaaaattggtacgtcattaaaaagtaacagattgccgtaaattaccggtttcacctgttactaatttcgcgaccggatccgtcctaacaataaaccttatttaacacaaaccacatccatatcctctgttcatttgattttggaaaaagtagcatatccagtagtttcagggaattcattttaactttaagaattctgatatatttaatttataaatttcggactgatataatagagttttggaaaactataagaaatgctttgttaatgtgtgtattcctatgtaaaacacatggcttttcctgtgtatatttttaaaaattaaagaaatgcacatttaaaaagtgaaaaaaaagtcgacgcggccgcgaat

SEQ ID NO: 442526 - DNA, 6093 bp, Homo sapiens
ccccccagccctcgtccgtggaagaaatgtcttccacgaaactggtccctagtgccaaaaaggttggggaacactgagttagggagtgatggggaaacacctcccccaaactcccaggtttctatatgccagccaagaggtgactttgtaagcaggactttctaagggtagtagtctatgacctgctgtgttaactcctttctgcacatcgtggtacccagggaagtttgttttcttctacctctttatatggaatatgaagcatttgcactaaatcatctctcttgaggaaatttagtaacaaccagaacgttttgagaatgacttgaacagtgtaactgggtttaataagtgagtttattcacttagacatattttctcaaaaataatactgccttgacagtattattcacagcctgtgctggttgttgtaatgataaaaatgattcctttcacagtaaaattttcttatttccaaaaataaaaaaattatatctttctgagtatccatttgaaaaatcacatctatgaatgtgaccatcagcttcaaagcagatactggtttttcttcacttttcttccatctttcatggtccaaaaggcccattagaaacttgccatctttgggtttgcttaagtgagtaaccaatccttcctttgtttttttataggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagtgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgttgtatttttctttctttcttttttttttttttttttttaccctttttctccttaggccaagtttagcttattcttatctttccacccaaacacctacacaacgtttaggcttcctgtaaggtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcattgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaacggtttccacatatcagttatagacaaaggccatgggactatgctaaaccaataaaaccttattagcaaatctttagattctgacttagccagagcatctgagtgttcaagtacagttttacagtggctaaggttgtctcttgatcttttttctccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttgggacagtggatactgcaacagccaagaactcttggttatccgcacaagctgctggtagactacattagccctctggttttccagctcaacctctgataaagtggactgagagccacgctgctcagtctgtttcgtcagccgactcaggttattttcagggaaggcatggaggcatagtttggttagtttcatcactaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaaca

SEQ ID NO: 442527 - DNA, 5550 bp, Homo sapiens
acctgcagttataacaaaaggagtttgacagtgtattgcatttcctcaacctctatatattttataatcttagctttaatttttaatgcatgtgaccagaaaataagctatggaagtttacttatctacctcagtagtttatactggaaaatcagaatggtagaagggagctcagaagtgtccagaaaacaatcgaatgcattgcttattcatgcttcttttccaagagcagcaaataagttacgagcttgaatgtagttagattttgagtaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagtgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgttgtatttttctttctttcttttttttttttttttttttaccctttttctccttaggccaagtttagcttattcttatctttccacccaaacacctacacaacgtttaggcttcctgtaaggtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcattgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaacggtttccacatatcagttatagacaaaggccatgggactatgctaaaccaataaaaccttattagcaaatctttagattctgacttagccagagcatctgagtgttcaagtacagttttacagtggctaaggttgtctcttgatcttttttctccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttgggacagtggatactgcaacagccaagaactcttggttatccgcacaagctgctggtagactacattagccctctggttttccagctcaacctctgataaagtggactgagagccacgctgctcagtctgtttcgtcagccgactcaggttattttcagggaaggcatggaggcatagtttggttagtttcatcactaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaaca

SEQ ID NO: 442528 - DNA, 2705 bp, Homo sapiens
tgggaaattttattaaaagggtttttttcatagaaaaacccgccgatccagggccctggaaccttggggacccaaataaaggggcaattcatatttatgtgcaaacccttagtggtttttatgatgagtattgatggtatattggttatgttcatgtccggagagtatattttgaagaggatagctattagaaggattatggatcgtttgcttgcgtgaggaaaatacttccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcattgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaacggtttccacatatcagttatagacaaaggccatgggactatgctaaaccaataaaaccttattagcaaatctttagattctgacttagccagagcatctgagtgttcaagtacagttttacagtggctaaggttgtctcttgatcttttttctccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttgggacagtggatactgcaacagccaagaactcttggttatccgcacaagctgctggtagactacattagccctctggttttccagctcaacctctgataaagtggactgagagccacgctgctcagtctgtttcgtcagccgactcaggttattttcagggaaggcatggaggcatagtttggttagtttcatcactaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccacatccatatcctctgttcatttgattttggaaaaagtagcatatccagtagtttcagggaattcattttaactttaagaattctgatatatttaatttataaatttcggactgatataatagagttttggaaaactataagaaatgctttgttaatgtgtgtattcctatgtaaaacacatggcttttcctgtgtatatttttaaaaattaaagaaatgcacatttaaaaagtg

SEQ ID NO: 442529 - DNA, 1839 bp, Homo sapiens
  misc_feature (1827)..(1827): n is a, c, g, or t
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataaggattcactttaagagatttggaaactcttccctttggaattgctcttcccatcagagatgcaatttatcactgtcgtgaacagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaatgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttgggctgagataggacggcctcctggtcctgaaatggaatactgcactgacagagagtcatactccttagctgctggcttggccctgggcatggtctgcttgggggcatggcaagcaaatttggatagggtatggctggatcttcaatgngccctgaacaag

SEQ ID NO: 442530 - DNA, 1851 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataaggattcactttaagagatttggaaactcttccctttggaattgctcttcccatcagagatgcaatttatcactgtcgtgaacagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaatgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgctgctctcttacccccaacgtccacagagctggatgttcctcacaatgtccaagtggctgcagtggttggcattggccttgtatatcaagggacagctcacagacatactgcagaagtcctgttgggctgagataggacggcctcctggtcctgaaatggaatactgcactgacagagagtcatactccttagctgctggcttggccctgggcatggtctgcttggggcatggcagcaatttgataggtatgtctgatctcaatgtgcctgagcagctctatcagtacatggttggaggacgtaggcgctttcaaacaggaatgcatagggagaaacataaatcaccaagt

SEQ ID NO: 442531 - DNA, 1653 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataaggattcactttaagagatttggaaactcttccctttggaattgctcttcccatcagagatgcaatttatcactgtcgtgaacagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaatgtagtgcagtacccagagctcagtgaccacgagttcatcgaggaaaaggaaaacaggtgaaagaaaacacgtgcactatctcttgtcatgtttcattgttacatttgtgtcttgtgtatatttgtttttccttcaagtttttagcatttaaaaccctaaagagatttaaaagatactttcaagtgaaaatatgccctgtgttttaagttttcatccaacttcaacaaacacgtgtgttagcaaaatgtctttggcttttgaggacgtaattgttgtatttcatatcgtcctcctcttgaaatacatataacactttactctttagaaaaggtgaatgtaaaactattttgcctgatagttaccttaagaatttacaaacaaagaaaacactggacttgtttttctgtgtcttgatcaggaatagattttgaggttagtggggtttttagtgtagtttaaacttgtatgagtattttttttttttggatatgatagatgatactccaaataaaaatagataagcctttcttctgccactcccctgcacaggatacatcccttgatacattataagactcacatgcctatgacattccagagctattctcttgggacacttctgttttaaaattctctcctgttcttt

SEQ ID NO: 442532 - DNA, 363 bp, Homo sapiens
gggaggcaaagagtctgtcctggagccataatggagccataaggatggtggttcccatgtgagctaaaatatccctacctcagaggagtcgggctttcagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttgggctgagataggtatgggattaatagtgctgaatcttc

SEQ ID NO: 442533 - DNA, 667 bp, Homo sapiens
caactaattttcaggtatcaggattacttaaaatctaatacatcttgtattttcagtgcgggtaaaaaggactattttagcctgaaggaaattattgtaccattgactcttgaacaacatgagtttgagttgtgtgggtccacttacaatgaaattcttttcagccaaatgcagatagaaaatgcagtattctctgatgtgaaacccatatgcaggttctgcagggccagttgtccaggaccttgagcatgcacggaatttgggtaccgccatggggtgtccctaaccaatcccctgaggtattctgagggccttgactgtacctttcagcctgccacagtattgccttatctaattttttttagatgttgtttgctaaatgattcttaatttcaaatgttttctacatgttacatgttttctttaccaggatgactatcaaaattgtttcattttgttgccttttagccccccagaagttgcaagtagaacaagaggaaaacaggtgacttttatttagactgtgcttttatgtcaaacacttaaaacaatattatttactgttctgcttaataactttatgttttattctcttataggtttagtttcaggcattctacatctgtttctagtctagctgaaagattggttgtctggatgactaatg

SEQ ID NO: 442534 - DNA, 354 bp, Homo sapiens
gagtaagaacctgcagttataacaaaaggagtttgacagtgtattgcatttcctcaacctctatatattttataatcttagctttaatttttaatgcatgtgaccagaaaataagctatggaagtttacttatctacctcagtagtttatactggaaaatcagaatggtagaagggagctcagaagtgtccagaaaacaatcgaatgcattgcttattcatgcttcttttccaagagcagcaaataagttacgagcttgaatgtagttagattttgagtgtaagggtgtttgacttttcttacctatgtagtagtgaccatagtaagccttaagaaaatagagatacacatagg

SEQ ID NO: 442535 - DNA, 2482 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgctttcaaaaacaaaaacctgtaagctcccttccctctctctttcttgtcatttggtctctgcacatgccagctccccttctccttctgccataaatggaattaacctaaagccctcaccagaagcagacgctggcactgtgcttcctgtgcagtctgcagaaccgtaaaccaaataaatctcctttcgttat

SEQ ID NO: 442536 - DNA, 5948 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagtgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgttgtatttttctttctttcttttttttttttttttttttaccctttttctccttaggccaagtttagcttattcttatctttccacccaaacacctacacaacgtttaggcttcctgtaaggtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcattgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaacggtttccacatatcagttatagacaaaggccatgggactatgctaaaccaataaaaccttattagcaaatctttagattctgacttagccagagcatctgagtgttcaagtacagttttacagtggctaaggttgtctcttgatcttttttctccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttgggacagtggatactgcaacagccaagaactcttggttatccgcacaagctgctggtagactacattagccctctggttttccagctcaacctctgataaagtggactgagagccacgctgctcagtctgtttcgtcagccgactcaggttattttcagggaaggcatggaggcatagtttggttagtttcatcactaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaaca

SEQ ID NO: 442537 - DNA, 6189 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagtttgataaattgaattgtggttatgaaactaatttgcatttttatttgcttaagaaagaaagctgtgatagattccagatatgctttttgatgttttcctctgctccagctccaagaagtcagcacacctgcattttagctctgcatgcagccccagcaggctgcgtgtttaagaatttcattgtttaactggctggtgtgagaagtcttccgttagcatagagtggaaggagtactattgtttggttgggtttttgtttgtttgttttttgtttttgcttttattgccaagaggtgcttgttttaaaagtatgtttaataaaatgaaattctaaagttagaagtgttcttaagttgatatttactctcttggtcttggtagccctattatatcattgcagacacagtgttgtgcatgtgtgtattgtatatgtgcaccagcatcaaacattgtgtatctggaaggaaagcagcatgttccagttctaaaatgcagttaccagacccatcactttaaatccttaaagttagaagctagcaaattttctgtagtgcagaacgtttattgctgtttttgtgtttgaatagtataatgtttgatgcctctcttctgcaaagcgtatcatctcattgactgtgaatctgtatattattctgatggatacagataatgatcttttctcttgtgaggtatcttcatttatgcactgtccaaaaatagccatgtgtaagagtctttctgtatgacgaactacatggaaaagacttctgtggacataattctgaccgaaacccatgaagttacttcagtataagaagaacgttacacggaaatcaccaaatattttgcaactttatttcttctgacatggagtgaacatcaataggaatactttcaaagaaaatgaaaacacagaagcaaagagaaatgtggcacttcacattttaaactacagatggacttggtttgagggagggggaatcacagatttggtgctaagttaattagaaactggcagcgttttacagtagtacaccagcctggatgttttttctaaaatgtttacctgggagagctggggtttgtttgtgaggagaaagagtactgtggaaaacctctgcttgagtaccatgtggccaggcctatgtggatggctactccgtgctgtgcggcttcaccagcggttgggattggcccagcttggagtgcttgtgtggtccaacctcagtctggccccatagtgacttttgccccatgattctgcttcactgttggaatcctctttgaagttccccctctctttgctaaagcagtgaaggaagagaacagagacaaactctttggactgtgaaagagaaggtagagaattccaggcaacagtctgaccaagggtgtaaaccagtttattatatatatatttttcctttgaattaaaacctagagtgttgtatttttctttctttcttttttttttttttttttttaccctttttctccttaggccaagtttagcttattcttatctttccacccaaacacctacacaacgtttaggcttcctgtaaggtttgaatgagacagatgtactctgaaggctggtggtaaatgtgtttgatgaccagactcttcatacagtcggcttgggccactttaaaggacaaaagccagagctcagctttatccctctcccagtgctgggagccaaaaaactgttgacggttttttgtgcagctcaagaaaactttgaaaagaacatgctttaactgaagcattggactctgcagctttctgtgtaaggcccgtgtactcccactgggcagggtgaggaccaaaaatctgaaactcttatgaatctgacatattatatggaaattatatcttgtgaccgtcttcaagtgcatggacttaaaattcatgagagactaaatgtgagggagaggtggatttaaagaggccagaccttaaccaaagatgctgagatacagcattctgtcccccctgccctagaaactccataaatgctgtcacaaccctatcattgctgatgctttctgcatgtcagcagtccaggaggatgctttttgtctctctttgcctccactttacaaaagataatatgatagaggcaacgtttataacagtcacatttaattataatgtacatcaaaggcagaatttcagaatggtttcttaaatttccttgggaacggtttccacatatcagttatagacaaaggccatgggactatgctaaaccaataaaaccttattagcaaatctttagattctgacttagccagagcatctgagtgttcaagtacagttttacagtggctaaggttgtctcttgatcttttttctccgttgtgtgatcacagatgctatttctgttttattggtgattatacgagacttctaatacataaatgaacgggtattggtgcctctttattttaaaaaatttgaagaaaagagccacctcatattcatagggtgtgtattttttgagtgtgagcatttaattgaaaataagaaagctatgaagtaaatgttaacttctctgtagcagctaatgcatagagacactaaaacccacaccacattttgtgggaaatgaggatcctgatcctcttttgtcctctccaggtagtctcgcaggttatgcagcttaagttcagtcttctttatgctgcgattgatttccacctcagtggcttagcctttgggacagtggatactgcaacagccaagaactcttggttatccgcacaagctgctggtagactacattagccctctggttttccagctcaacctctgataaagtggactgagagccacgctgctcagtctgtttcgtcagccgactcaggttattttcagggaaggcatggaggcatagtttggttagtttcatcactaggatgtataaggtgacgacacaaaccaaatacctttctttcatcacttaactatacgtactttatctctggtaacactagaatgctgtggtcttgagggaatgttagcaaggaacacatagaagatttggtgtttcataagcctgtctaggtgtggcaggttttgtgtggtacactgatgtttaccataagcaggtacaagcttcatgaaccgttcttaatgaactataattgaatagataccaaaaatagaatgacaaatgtattttaatagcagatgaggcagttttaggatgaattttccactgttgattttacttcaagacatagcaagagaaacaaaattttgttttcaagacatttccactgcagtttcaagctgtagtgggcatatgcttcatttacttccaaagaggcaaaagcagctggaattggcttacagcacatgctttgtttcatgttatgggtgaggacctacatacactcttactttagcagtcacttaaccttctccagcaaggcagttgtggggttcactaggatttagtgcctgatcttttttttgggaaggggcgggaatgaatgtgttggggctgggagggaagcagaagaaaatgggagtgtgagtgagtgtgcatgtgtctgaagttcaccattgcccccacctgcacctagcaaggaacaggtgtttgatgtattttgctcatgactgcagtatgcatgtatttttttccttctctgtgttttctaaacttacactaaaggattcatcaaatcatcttgttcagatggctcaggattgtatttattttgcttaccccgtgctcttgggttctatagtatttctataattatgtaacgagaatagtgttgcactgtaatctatcatatagagctatatgtatggaaaattttgatcaattttttaagaaatgtatcctgtttgcaaaggcacagtaaagttgcatcttatagactataggcaataaagctaacaataaaccttatttaacacaaaccacatccatatcctctgttcatttgattttggaaaaagtagcatatccagtagtttcagggaattcattttaactttaagaattctgatatatttaatttataaatttcggactgatataatagagttttggaaaactataagaaatgctttgttaatgtgtgtattcctatgtaaaacacatggcttttcctgtgtatatttttaaaaattaaagaaatgcacatttaaaaagtg

SEQ ID NO: 442538 - DNA, 1717 bp, Homo sapiens
catccccctccccccagtcggcggcgcttggtgccgcccgggagaaccaggtcatcggtcggttcccgtgaaaacaaaaacaatcggccgcgccgtcgcaggcacccgaacgtcgcgagcggggcctggggacgcggggccgagtgcagcgagcgaacgggagcagcggcgactcgccggggggctagggcgccatggggcaggcgggctccggctgcgcggggctcccccggcgccgcggctagtgcgcccgccgcctcggccgcctcagcctcccgcgccgcccgcttggggaacgaggagcaggacgcggcctcggcggggcccgggccgaacggctgcggacacctgggcgccgaggagccgagcgccgccgcctccggcatggatcagtgcgtgacggtggagcgcgagctggagaaggtgctgcacaagttctcgggctacgggcagctgtgcgagcgcggcctggaggagctcatcgactacaccggcggtctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataaggattcactttaagagatttggaaactcttccctttggaattgctcttcccatcagagatgcaatttatcactgtcgtgaacagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaatgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttgggctgagataggtatgggattaatagtgctgaatcttc

SEQ ID NO: 442539 - DNA, 1392 bp, Homo sapiens
  misc_feature (1380)..(1380): n is a, c, g, or t
cgggaatctgtgaaagaagcagacttgtagtcttgagtattgcactgtacatacttggtgatgagagcttggtttctgatgaatcctcacagtatttaaccagaataactatagccccccagaagttgcaagtagaacaagaggaaaacaggtttagtttcaggcattctacatctgtttctagtctagctgaaagattggttgtctggatgactaatgtaggattcactttaagagatttggaaactcttccctttggaattgctcttcccatcagagatgcaatttatcactgtcgtgaacagcctgcctcagactggccagaagctgtctgtctcttgattggacgtcaggatctttccaagcaggcctgcgaaggaaacttacccaaagggaagtctgtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaatgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttgggctgagataggacggcctcctggtcctgaaatggaatactgcactgacagagagtcatactccttagctgctggcttggccctgggcatggtctgcttgggggcatggcaagcaaatttggatagggtatggctggatcttcaatgngccctgaacaag

SEQ ID NO: 442540 - DNA, 588 bp, Homo sapiens
tgagccggtccgtcatttaggtccatagcttattcctaaatagaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttgggctgagataggtatgggattaatagtgctgaatcttc

SEQ ID NO: 442541 - DNA, 3653 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatagccactcctttgtcactcgcatctcagctgctgccttcaccagccgtcagtcactcgggccagggcggggtcaccggacaggtgcatgttctgcctcagccctcagaccagggcgtactcagtggtccccgagctgcccgaggccagacagccccgcaggaggaagcggtgacccaggaagaggtcgaggcgctggtttgtggtcacacacagcggtgggtgcctgggccggtgtacgacgccgctgctggtggctctggctgggctcagctgagcctcagggctggaatgggtgtaggccaggccactgggcacattcaggaccccgcgagccagcggctgacgtggaacaagtccccaaagagcgtccttgtcatcaagaagatgagagatgccagcctactgcagccgttcaaggagctctgcacgcacctcatggaggcacgcggggcaggggggaagggggcctggggtgcacatggagttgggggggcctccatccacatcaccgccccgagggtggggtctgcaggtggaatgagcaggttggcactttgcttccaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442542 - DNA, 207 bp, Homo sapiens
cgcgttgaatggcccggaggcgttgaatggcccggaggcgttgaatggcccgagaagattatgatgacatttccaatcagatagacttcatcatctgcctggggggagacgggacgctgctgtacgcttcctcgcttttccaggtgaagcgctgacatttccagacccacaccaggttctagtctaggtgctgcgtaacgaggggct

SEQ ID NO: 442543 - DNA, 766 bp, Homo sapiens
  misc_feature (726)..(726): n is a, c, g, or t
  misc_feature (747)..(747): n is a, c, g, or t
  misc_feature (752)..(752): n is a, c, g, or t
agtgggcgggcgcggcgcattgctgctcggcggcgccggcgccggggtccgggcggccatggggcaacaggcggccagggcgccaagggccaggtagcgacggctggcggcggcgcggcggcggggcctgcgggctcggtccggcatgtagacgcccccgcaggcgcccgcggcagcgaacggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaagaaaaatttcttgtacccttttcnaaggaaagaattattgaatgnaccanttttccccaattca

SEQ ID NO: 442544 - DNA, 3125 bp, Homo sapiens
ggatcacaatgtcgggggcgcctaggcgtagacgtggcgggcggacccgggggcgccctccggacgcggcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442545 - DNA, 3789 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggcacgcggggcaggggggaagggggcctggggtgcacatggagttgggggggcctccatccacatcaccgccccgtgagaccatgggaaccacctcaagtgctgggcaacggctgcttgtctggaactggggactgagtggggatctgccgggtgtctgggtttgtgtgtgccgccatggcaagcaccagactgggtgaccaacaatgagctggtgggctcgtggcctggaggccgggaagtccgagatcaaggggccacatctgacgtgggccttcctgctgtgtcttctcttcagaagagcaggcgtgggggttgcggcgcccaggaaagccactcctgaaataacagccttagtcaattcctgagagggagccccctccgcccagtcatctcttaaaggtcctgcttcctcctggcgcgttggtgatgaagtttcagcgtgagcgtgggggggcgggcatgcaggccacgatgccaggtctctgaccacagcgcccgtgagtcgggaacctccctgcaggagggtggggtctgcaggtggaatgagcaggttggcactttgcttccaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442546 - DNA, 4008 bp, Homo sapiens
ggatcacaatgtcgggggcgcctaggcgtagacgtggcgggcggacccgggggcgccctccggacgcggcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatagccactcctttgtcactcgcatctcagctgctgccttcaccagccgtcagtcactcgggccagggcggggtcaccggacaggtgcatgttctgcctcagccctcagaccagggcgtactcagtggtccccgagctgcccgaggccagacagccccgcaggaggaagcggtgacccaggaagaggtcgaggcgctggtttgtggtcacacacagcggtgggtgcctgggccggtgtacgacgccgctgctggtggctctggctgggctcagctgagcctcagggctggaatgggtgtaggccaggccactgggcacattcaggaccccgcgagccagcggctgacgtggaacaagtccccaaagagcgtccttgtcatcaagaagatgagagatgccagcctactgcagccgttcaaggagctctgcacgcacctcatggaggcacgcggggcaggggggaagggggcctggggtgcacatggagttgggggggcctccatccacatcaccgccccgtgagaccatgggaaccacctcaagtgctgggcaacggctgcttgtctggaactggggactgagtggggatctgccgggtgtctgggtttgtgtgtgccgccatggcaagcaccagactgggtgaccaacaatgagctggtgggctcgtggcctggaggccgggaagtccgagatcaaggggccacatctgacgtgggccttcctgctgtgtcttctcttcagaagagcaggcgtgggggttgcggcgcccaggaaagccactcctgaaataacagccttagtcaattcctgagagggagccccctccgcccagtcatctcttaaaggtcctgcttcctcctggcgcgttggtgatgaagtttcagcgtgagcgtgggggggcgggcatgcaggccacgatgccaggtctctgaccacagcgcccgtgagtcgggaacctccctgcaggagggtggggtctgcaggtggaatgagcaggttggcactttgcttccaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442547 - DNA, 3164 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctcagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442548 - DNA, 3115 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442549 - DNA, 3245 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaaggtcagagccaacgacactccttttccgatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442550 - DNA, 3060 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacgatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442551 - DNA, 3103 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggaggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctcagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442552 - DNA, 3800 bp, Homo sapiens
  misc_feature (3252)..(3252): n is a, c, g, or t
  misc_feature (3255)..(3255): n is a, c, g, or t
  misc_feature (3257)..(3257): n is a, c, g, or t
  misc_feature (3259)..(3259): n is a, c, g, or t
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataaaaaaaaaaaaacaaaaaaaaaaaaaaaaaaaaanaanananaaaaaaaaaaaaaaaaaaaaaaagaggggggggagcccgacagaaagaaactcccccggagggggcgcccgaacagcacgcgcgcgcacccgcgtttgatacaaaaaaggggccccaccaaaggaggaggcgcactatcaaaaaagaagcgaggcgcgcgccgcgggatacacacgaccgtgtgtctgtggtggggcggaaaacacaggcgcccacagacgaggagacctattttgtgggaggaggaggcgcaccccacatatgacgcgggggggggggagagccccaatatgttgtggcgacacaaccaattcactccagaacggagaaaaatataattatgaaagcaccctccagaaggggggaacatattaatataacgactacgtgtcagagagggggtggtacataggtgggggggatcaacacaacaacgtggagtataatctatctggggagcggggaacaacagaaaaacgtgtgtgtcggcacacacgggagttagttagacaataatgacaaaaacatatttttttacccc

SEQ ID NO: 442553 - DNA, 2045 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442554 - DNA, 3315 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaat

SEQ ID NO: 442555 - DNA, 1853 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctaaatgttgatttttgcttctaagacgtgaaagggggaggttggcgggacccgggggccgagggcccagcgatcagcggattcgaaggtaatagggaggcgtggtaatccaaaaaaaaaggtggggaagagggtcctagggccggaaa

SEQ ID NO: 442556 - DNA, 563 bp, Homo sapiens
gtgggggggcgggcatgcaggccacgatgccaggtctctgaccacagcgcccgtgagtcgggaacctccctgcaggagggtggggtctgcaggtggaatgagcaggttggcactttgcttccaggagaacatgatcgtgtatgtggaaaagaaagtgctagaagaccctgccatcgccagcgatgaaagctttggggcagtgaagaagaaattctgtacctttcgagaaggtgggctgtcagcagctctgtccttggtttctccagcacagttccccgccccattggaagcttctggcactgttgcccttgtcattggtgtctgcgcactgcgccacagaggggccactgtgtgacagcctcttcttggttttgctttgtgtttcctagattatgatgacatttccaatcagatagacttcatcatctgcctggggggagacgggacgctgctgtacgcttcctcgcttttccaggtgaagcgctgacatttccagacccacaccaggttctagtctaggtgctgcgtaacgaggggctcacaagcatggcttccattgcttt

SEQ ID NO: 442557 - DNA, 3235 bp, Homo sapiens
agtgggcgggcgcggcgcattgctgctcggcggcgccggcgccggggtccgggcggccatggggcaacaggcggccagggcgccaagggccaggtagcgacggctggcggcggcgcggcggcggggcctgcgggctcggtccggcatgtagacgcccccgcaggcgcccgcggcagcgaacggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442558 - DNA, 3218 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442559 - DNA, 3674 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatagccactcctttgtcactcgcatctcagctgctgccttcaccagccgtcagtcactcgggccagggcggggtcaccggacaggtgcatgttctgcctcagccctcagaccagggcgtactcagtggtccccgagctgcccgaggccagacagccccgcaggaggaagcggtgacccaggaagaggtcgaggcgctggtttgtggtcacacacagcggtgggtgcctgggccggtgtacgacgccgctgctggtggctctggctgggctcagctgagcctcagggctggaatgggtgtaggccaggccactgggcacattcaggaccccgcgagccagcggctgacgtggaacaagtccccaaagagcgtccttgtcatcaagaagatgagagatgccagcctactgcagccgttcaaggagctctgcacgcacctcatggagaagagcaggcgtgggggttgcggcgcccaggaaagccactcctgaaataacagccttagtcaattcctgagagggagccccctccgcccagtcatctcttaaaggtcctgcttcctcctggcgcgttggtgatgaagtttcagcgagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442560 - DNA, 3293 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggtaaggcccgcagcactgtcctggggccctgagcgtccctcgggcgggagtgacgcctgcgcctgtccctgtcaggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442561 - DNA, 3619 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaaggtcagagccaacgacactccttttccggtttgtgagtcatttgaccccgtgcaacacaaagccgggacctagcaccccgctctgccatgctggctccagcctcagacgcggcctcgtcatcctagggccatcctgtgccccctcagatgcaagccttcccttgctggtgcccgagttctgtccatcaaggtgcccagggcccgggtctgaggggctttctgccattgttggtctctggcggtgctgagctgggccggtgcctgtaggacgtgcactgcaccgtccgcaaggcagggtcagagctgcccaaccttcgacctctggcgagcactcaggggtgggtgcctagaagcgtcctccccacagctgggggcccacacctctccctgcttgaccctcagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442562 - DNA, 3135 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442563 - DNA, 3032 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442564 - DNA, 3677 bp, Homo sapiens
  misc_feature (3252)..(3252): n is a, c, g, or t
  misc_feature (3255)..(3255): n is a, c, g, or t
  misc_feature (3257)..(3257): n is a, c, g, or t
  misc_feature (3259)..(3259): n is a, c, g, or t
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataaaaaaaaaaaaacaaaaaaaaaaaaaaaaaaaaanaanananaaaaaaaaaagggggggcacacactagataggaatatactccacatgagggaggcaaccacaaagatataatacgagtcacataccaagagaaatgatgtccggtcaacacaagggcgtgtcccacacaaaataacagtggcgcgcgctcatatatagaacgttgcagcagcaaggtacgacacaaacaaatatactagaagcagtgaggataggagtagatgggcggacaaacagccctcgacgtgacatgatgagaggagcacaactctctcggggaagaaagggagacgcctgtgtatatactctcaggggaggggaggagtgaacaacacacattagtggtgcgagaaaaatacttgcactgacagcgaaggagatagtcaaacgggccctccagagggggggagaataagaag

SEQ ID NO: 442565 - DNA, 2961 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccagcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 442566 - DNA, 455 bp, Homo sapiens
gccctcccggccccgccgtggctctgtcccgccatcctgtgcttgctgtgtccctggcaccccaccgggcctctcccccgctgcctggtgccctccctgcacttcctggtcctggcagagccactcctttgtcactcgcatctcagctgctgccttcaccagccgtcagtcactcgggccagggcggggtcaccggacaggtgcatgttctgcctcagccctcagaccagggcgtactcagtggtccccgagctgcccgaggccagacagccccgcaggaggaagcggtgggtttgtggggcagccttgaggggcatgcagctttctcggcacccccatgggagcacgccccctctgggctctgtgtctctgggatcataacctcccgcttcccatccccgctgtggaggggcagggcttcccatgcatctgaacttccgtcttccctgatagtc

SEQ ID NO: 442567 - DNA, 644 bp, Homo sapiens
ctattagcagaaaaatactaacatgtacaagaaaggatttgtattagtttatttcaccacagtagtatttcattacacataatccctaaaactcagcagcttgcaataagtgtttatactcatgcttatgggtgtgtaggtcaactgtgtttcagtggatgtatttaagcactgacttaggcgcatgttaacctcaatctgctccaggtagatttgttctatggctgtagcagcagcagctacctgagtcatgcttttctagtggcttgtcactgaagatcataagccaggccaaagcacttagccaagtttaaggacactactcatgtcatatctgctaacacccgttgttcaaacaagtaacatggccaagcctaattatgaaggaacaggaagtatactggccctacagaaggagagggaatgaaatgaatatttgatgaacagtattatgctatcagcttcatattagatgtttatttctagtattttacaaactatccacttgtactcaaataaaatgagtcaagtatttttagattccccacatttatttagctgaaaaggacactcctctgttaatacaactatatgtgtacatagttttgtgaatttcagctacattcagtccccacctgccctcc

SEQ ID NO: 442568 - DNA, 4973 bp, Homo sapiens
  misc_feature (4973)..(4973): n is a, c, g, or t
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaaaaaaaaaaagggggggaaagataccaaggggcgagttgggacacattttgaaagggctaaaaggagtaaaaaggcggggggtaaagggggagacacttgtttagggaactgggggatgcaccacaccacggaaaagatagagacctgtctattgtgtgcaan

SEQ ID NO: 442569 - DNA, 315 bp, Homo sapiens
cgagctcggtaccctgcacacgccgaagccccatacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggtggctcggcgtgtgcagagaatactctac

SEQ ID NO: 442570 - DNA, 4524 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442571 - DNA, 4792 bp, Homo sapiens
cctgttacgcccggaattactgggagtcgaggtccgagcttatgtgcctggtactggctagtgtgcttgtcgtgcgaggtcacgtgactcgggcttagtgtgcctgcatgtggagtgcaggcgtgtgtgacagcctagactaagcatgtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442572 - DNA, 4028 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442573 - DNA, 2660 bp, Homo sapiens
gagcagctacgggtgaggtacagctacgggtgaggtacagctacgggtgaggtacagctacgggtgaggtacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442574 - DNA, 4792 bp, Homo sapiens
  misc_feature (4792)..(4792): n is a, c, g, or t
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaaaaaacacacaaaaaaaaactcggatattccgctatggcccatttaatcggaggttcctaagctacggaggaaatgtgtattaaactaagcacggccagttgtggccctagggttataacctgggctataacttcagacctaaaggaatttaaaactatataggcagatgtccaagttttgaaacaccaaaacgggaagggcattagctcagtatgtgggaccaggggaaagtagatcatgagtccgagagtggcaagatataacccan

SEQ ID NO: 442575 - DNA, 4548 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaaaaaaacacaacaaccccaacaacc

SEQ ID NO: 442576 - DNA, 4585 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaaagtgcactttttccccactttgaatttaaattgagaataaaggaaatggactcattgtagg

SEQ ID NO: 442577 - DNA, 4742 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgctctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442578 - DNA, 4208 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactgaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442579 - DNA, 4136 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccgctacacagctgaagaggaatcctcgggagcagccctcc

SEQ ID NO: 442580 - DNA, 4172 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggcacgtgggccacaaccacacatacaacattgcacccattgccctggactcagccgacctgccaccacccagtgccctcaagaaaggcagcaaggagaagcaggctgacttcctggacaagcagatgagccgggatgagcaccgagcccgagccatgaagatccctttcaccaatgaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442581 - DNA, 3940 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatat

SEQ ID NO: 442582 - DNA, 3655 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttgcgacgtgtgaccgtgggtgggcgcctaaatctcaccgtggtgtgtgtgatataaaccccccattttcaccccccgggggggggtgttggggttacccccggaccaccgcgggtgtggcggcgttggcgagagcggcgccgggtgttttaagcctcttctcgtgcctcctgtgtgccatttgtgagacatctcccttagaagcg

SEQ ID NO: 442583 - DNA, 3382 bp, Homo sapiens
  misc_feature (3336)..(3336): n is a, c, g, or t
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggcggacgagggccgccctttaacggaggggctcaacctaacccttccgtgagcacggcgggggggaaagtcaggaaaaggcctctgttgtcacagcggcagacaggaaggaatgatcctctcgcaaggcaggggcgaaacacctccaagagaggagcaacgagagagagctccccccaaaaaagagtggacggattacggggacgaggacgcgtccaagcgagcagacattgacggcctgctcgacggtgatgacacgtgagaccctattccancagccaatcacggcttgcgtcatccatgacgcagctacagacacgc

SEQ ID NO: 442584 - DNA, 2532 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaataaaataaaatggatgattcattcttaaagtgcactttttccccactttgaatttaaattgagaataaaggaaatggactcattgtagg

SEQ ID NO: 442585 - DNA, 911 bp, Homo sapiens
cctgttacgcccggaattactgggagtcgaggtccgagcttatgtgcctggtactggctagtgtgcttgtcgtgcgaggtcacgtgactcgggcttagtgtgcctgcatgtggagtgcaggcgtgtgtgacagcctagactaagcatgtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacccagaccagcttacgggatcgtctagatcgacc

SEQ ID NO: 442586 - DNA, 4825 bp, Homo sapiens
cctgttacgcccggaattactgggagtcgaggtccgagcttatgtgcctggtactggctagtgtgcttgtcgtgcgaggtcacgtgactcgggcttagtgtgcctgcatgtggagtgcaggcgtgtgtgacagcctagactaagcatgtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442587 - DNA, 4644 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagtcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442588 - DNA, 2749 bp, Homo sapiens
cctactatctgattcagatcgtctcatcctctgaggcaggggagcagctgtgttcatcgctgctggttcattcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442589 - DNA, 4545 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaaaaaaaaaaacacaacaacacg

SEQ ID NO: 442590 - DNA, 4811 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaaaagcaaaaaacaaaaaaaaactttgaaattgttcctattgggacccaatataagcgaagggtaaccaaagggtatccggaagaaaattctgcgttattaaattgcgaagggccacagttgggcccctaggtatacacctttggtaagcataaattttaaaagaggcctaaaacgacattatacaaacatataatagggcgcgatatagtccactgttttatataaccccaaaacacctgaataagaggtatatatgacacacagtactgagagaaacagcacgagag

SEQ ID NO: 442591 - DNA, 2520 bp, Homo sapiens
cctgttacgcccggaattactgggagtcgaggtccgagcttatgtgcctggtactggctagtgtgcttgtcgtgcgaggtcacgtgactcgggcttagtgtgcctgcatgtggagtgcaggcgtgtgtgacagcctagactaagcatgtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccaacactggctttgagatttagagtcaaagggtagagtgaacaggaaagggtcacgtggtcccatgttgcaacagccccaacatcacgcatgtcattcaatgccttgccactccatctccctccgtgctccacctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccccgaaaaaaaaatcaaagcgggaagaaaatcagagggaaggttaaggttggctctggccaggattccaggcagcaggttggagtgactggtgggcctagatcactggtgtgataaaccccatttcaccccggggggggtggggtacacagacacagggtgggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 442592 - DNA, 4462 bp, Homo sapiens
agtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggggttggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgattttatattgggcatctcctttttactcaacacaagcattctagaccctatccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa
